United States Patent 11,479,782 (ALFALFA WITH REDUCED LIGNIN COMPOSITION) - sequence listing, part 5

SEQ ID NO: 26189 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 26190 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 26191 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 26192 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 26193 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 26194 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagtcatgttggaccgaatgttgcgtctcttggcttgttacaatatcctcacgtgttctgttcgtactcaacaagatggaaagattcagagactttatggtttggctactgttgctaa

SEQ ID NO: 26195 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagatatgttggaccgaatgttgcgtctcttggcttgttacaatatcctcacttgttcagttcgtactcaacaagatggaaaggttcagagactttatggtttggctactgttgctaa

SEQ ID NO: 26196 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgacgcaccagttatgttggaccgaatgttgcgtctcttggcttgttacaatatcctcacttgttcagttcgtactcaacaagatggaaaggttcagagactttatggtttggctactgttgctaa

SEQ ID NO: 26197 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26198 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccgtgggcctggcacagcaccggcaacagcgcctgcaccgtctccagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26199 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccgtgggcctggcacagcaccggcaacagcgcctgcaccgtctccagccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26200 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccgtgggcctggcacagcaccggcaacagcgcctgcaccgtctccagccctgatgcaccagttatggtggaccgaatgttgcgtctcttggcttgttacaatatcctcacttgttcagttcgtactcaacaagatggaaaggttcagagactttatggtttggctactgttgctaa

SEQ ID NO: 26201 - DNA, 457 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccggggtcaagccgtgggcctggcacagcaccggcaacagccgctggaccgtctccagcgcctgcttgccgccgccattgctggcgatggccaccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26202 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacccttatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26203 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 26204 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26205 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26206 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 26207 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagtttccgagactttatggtttggctcctgttgctaa

SEQ ID NO: 26208 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 26209 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagtctttatggtttggctactgttgctaa

SEQ ID NO: 26210 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26211 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcatttgttcagttcgtactcaacaagatggaaagattcagagactttatggtttggctactgttgctaa

SEQ ID NO: 26212 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 26213 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggcactgttgctaa

SEQ ID NO: 26214 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26215 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 26216 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggcttggctactgttgctaa

SEQ ID NO: 26217 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 26218 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagattttatggtttggctactgttgctaa

SEQ ID NO: 26219 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 26220 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 26221 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctctgttgctaa

SEQ ID NO: 26222 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggagactgttgctaa

SEQ ID NO: 26223 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 26224 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 26225 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgttaa

SEQ ID NO: 26226 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggcttggctactgttgctaa

SEQ ID NO: 26227 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaatgttcagagactttatggtttggctactgttgctaa

SEQ ID NO: 26228 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcgtggcttgttacaatatcctcacttgttcagttcgtactcaacaagatggaaaggttcagagactttatggtttggctactgttgctaa

SEQ ID NO: 26229 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 26230 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 26231 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 26232 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctact

SEQ ID NO: 26233 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttaagttcgtactcaacaagatggaaagattcggagactttatggtttggctactgttgctaa

SEQ ID NO: 26234 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcaggtcgtactcaacaagatggaaaggttcagagactttatggtttggctactgttgctaa

SEQ ID NO: 26235 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctctgggcttgttacaatatcctcacttgttcagttcgtactcaacaagatggaaaggttcagagactttatggtttggctactgttgctaa

SEQ ID NO: 26236 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttagggtttgctctgttgctaa

SEQ ID NO: 26237 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgtcacaatatcctcacttgttcagttcgtactcaacaagatggaaagattcagagactttatggtttggctactgttgctaa

SEQ ID NO: 26238 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagtctttatggtttggctactgttgctaa

SEQ ID NO: 26239 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttagaccgaatgttgcgtctcttggcttgttacaatatcctcacttgttcagttcgtactcaacaagatggaaaggttcagagactttatggtttggctactgttgctaa

SEQ ID NO: 26240 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttagaccgaatgttgcgtctcttggcttgttacaatatcctcacttgttcagttcgtactcaacaagatggaaagattcagagactttatggtttggctactgttgctaa

SEQ ID NO: 26241 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 26242 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 26243 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 26244 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 26245 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26246 - DNA, 427 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacccgttattaaaaactagccgttaaaaaactagcctttgttaaaactagccggtaaaaaactagccgctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26247 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26248 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26249 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacccgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 26250 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26251 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26252 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26253 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 26254 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 26255 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccagttatgttggaccgaatgttgcgtctcttggcttgttacaatatcctcacttgttcagttcgtactcaacaagatggaaagattcagagactttatggtttggctactgttgctaa

SEQ ID NO: 26256 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccagttatgttggaccgaatgttgcgtctcttggcttgttacaatatcctcacttgttcagttcgtactcaacaagatggaaaagttcagagactttatggtttggctactgttgctaa

SEQ ID NO: 26257 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccagttatgttggaccgaatgttgcgtctcttggcttgttacaatatcctcacttgttcagttcgtactcaacaagatggaaaggttcagagactttatggtttggctactgttgctaa

SEQ ID NO: 26258 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccagttatgttggaccgaatgttgcgtctcttggcttgttacaatatcctcacttgttcagttcgtactcaacaagatggaaagatttagagactttatggtttggctactgttgctaa

SEQ ID NO: 26259 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccaggccgacgaaatgcagaggtacgtggaggagaaccagaccaggaacaagcacatcaaccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26260 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccacctgctccggggtcaagccgtgggcctggcacagcaccggcaacagccgctggaccgtctccagcgcctctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26261 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccacctgctccggggtcaagccgggggcctggcacagcaccggcaacagccgctggaccgtctccagcgcctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26262 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccaccagttatgttggaccgaatgttgcgtctcttggcttgttacaatatcctcacttgttcagttcgtactcaacaagatggaaagattcagagactttatggtttggctactgttgctaa

SEQ ID NO: 26263 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccaccagttatgttggaccgaatgttgcgtctcttggcttgttacaatatcctcacttgttcagttcgtactcaacaagatggaaagattcagagcctttatggtttggctactgttgctaa

SEQ ID NO: 26264 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccaccagttatgttggaccgaatgttgcgtctcttggcttgttacaatatcctcacttgttcagttcgtactcaacaagatggaaaggttcagagactttatggtttggctactgttgctaa

SEQ ID NO: 26265 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgttggaccgaatgttgcgtctcttggcttgttacaatatcctcacttgttcagttcgtactcaacaagatggaaaggttcagagactttatggtttggctactgttgctaa

SEQ ID NO: 26266 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgttggaccgaatgttgcgtctcttggcttgttacaatatcctcacttgttcagttcgtactcaacaagatggaaagattcagagactttatggtttggctactgttgctaa

SEQ ID NO: 26267 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgttggaccgaatgttgcgtctcttggcttgttacaatatcctcacttgttcagttcgtactcaacaagatggaaaagttcagagactttatggtttggctactgttgctaa

SEQ ID NO: 26268 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgttggaccgaatgttgcgtctcttggtttgttacaatatcctcacttgttcagttcgtactcaacaagatggaaagattcagagactttatggtttggctactgttgctaa

SEQ ID NO: 26269 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26270 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 26271 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26272 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaagttcagagactttatgggttggctactgttgctaa

SEQ ID NO: 26273 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatcgaaagattcagagactttatggtttggctactgttgctaa

SEQ ID NO: 26274 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaggttcagagactttatggcttggctactgttgctaa

SEQ ID NO: 26275 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcactttttcattccgtactcaacaagatggaaagattcagagactttatggtttggctactgttgctaa

SEQ ID NO: 26276 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggctcgttacaatatcctcacttgttcagttcgtactcaacaagatggaaaggttcagagactttatggtttggctactgttgctaa

SEQ ID NO: 26277 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 26278 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26279 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26280 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26281 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgaaccagtgatgttggaccgaatgttgcgtatcttggcttgtaaaaatatcctcacttgttcagttcgtactcaacaagatggaaaggttcagagacgttatggtttggctactgttgctaa

SEQ ID NO: 26282 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacagttatgttggaccgaatgttgcgtctcttggcttgttacaatatcctcacttgttcagttcgtactcaacaagatggaaaggttcagagactttatggtttggctactgttgctaa

SEQ ID NO: 26283 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacagttatgttggaccgaatgttgcgtctcttggcttgttacaatatcctcacttgttcagttcgtactcaacaagatggaaagattcagagactttatggtttggctactgttgctaa

SEQ ID NO: 26284 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacagataccaaatactgttcttctagtgtagccgtagttaggccaccacttcaagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26285 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacagataccaaatactgttcttctagtgtagccgtagttaggccaccacttcaagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26286 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacagataccaaatactgttcttctagtgtagccgtagttaggccaccacttcaagctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26287 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacacggatggcctttttgcgtttctacaaactcttcctggctagcggtacgcgtattaattgcgttgcgctcactgcccgctttccagtcgggaaacctgtcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26288 - DNA, 460 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacacggatggcctttttgcgtttctacaaactcttcctggctagcggtacgcgtattaattgcgttgcgctcactgcccgctttccagtcgggaaacctgtcctgatgcaccagttatgttggaccgaatgttgcgtctcttggcttgttacaatatcctcacttgttcagttcgtactcaacaagatggaaagattcagagactttatggtttggctactgttgtaa

SEQ ID NO: 26289 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacacggatggcctttttgcgtttctacaaactcttcctggctagcggtacgcgtattaattgcgttgcgctcactgcccgctttccagtcgggaaacctgtcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26290 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacacgcaattaatacgcgtaccgctagccaggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26291 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacacgcaattaatacgcgtaccgctagccaggaccctgatgcaccagttatgttggaccgaatgttgcgtctcttggcttgtcacaatatcctcacttgttcagttcgtactcaacaagatggaaagattcagagactttatggtttggctactgttgctaa

SEQ ID NO: 26292 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacacgcaattaatacgcgtaccgctagccaggaccctgatgcaccagttatgttggaccgaatgttgcgtctcttggcttgttacaatatcctcacttgttcagttcgtactcaagaagatggaaagattcagagactttatggtttggctactgttgctaa

SEQ ID NO: 26293 - DNA, 455 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacaccccccagcaggtggtggccatcgccagcaataatggtggcaagcaggcgctggagacggtccagcggctgttgccggtgctgtgccaggcccctgatgcaccagttatgttggaccgaatgttgcgtctcttggcttgttacaatatcctcacttgttcagttcgtactcgacaagatggaaagattcagagactttatggtttggctactgttgctaa

SEQ ID NO: 26294 - DNA, 455 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacaccccccagcaggtggtggccatcgccagcaataatggtggcaagcaggcgctggagacggtccagcggctgttgccggtgctgtgccaggcccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26295 - DNA, 455 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacaccccccagcaggtggtggccatcgccagcaataatggtggcaagcaggcgctggagacggtccagcggctgttgccggtgctgtgccaggcccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26296 - DNA, 455 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacaccccccagcaggtggtggccatcgccagcaataatggtggcaggcaggcgctggagacggtccagcggctgttgccggtgctgtgccaggcccctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 26297 - DNA, 455 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacaccccccagcaggtggtggccatcgccagcaataatggtggccagcaggcgctggagacggtccagcggctgttgccggtgctgtgccaggcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26298 - DNA, 442 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacaacgttcaaatccgctcccggcggatttgtcctactcaggagagcgttcaccgacaaacaacagataaaacgaaaggcccagtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26299 - DNA, 442 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacaacgttcaaatccgctcccggcggatttgtcctactcaggagagcgttcaccgacaaacaacagataaaacgaaaggcccagtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26300 - DNA, 442 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacaacgttcaaatccgctcccggcggatttgtcctacccaggagagcgttcaccgacaaacaacagataaaacgaaaggcccagtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26301 - DNA, 442 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacaacgtccaaatccgcccccggcggatctgtcctactcaggagagcgtacaccgacaaacaacagataaaccgaaaggccccgtgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26302 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26303 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26304 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26305 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26306 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaggtccagagactttatggtttggctactgttgctaa

SEQ ID NO: 26307 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 26308 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 26309 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacgatatcctcacttgttcagttcgtactcaacaagatggaaaggttcagagactttatggtttggctactgttgctaa

SEQ ID NO: 26310 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaggttcagagaccttatggtttggctactgttgctaa

SEQ ID NO: 26311 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagtcatgttggaccgaatgttgcgtctcttggcttgttacaatatcctcacttgttctgttcgtactcaacaagatggaaagattcagagactttatggtttggctactgttgctaa

SEQ ID NO: 26312 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 26313 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatacaccagttatgttggaccgaatgttgcgtctcttggcttgttacaatatcctcacttgttcagttcgtactcaacaagatggaaaggttcagagactttatggtttgctactgttgctaa

SEQ ID NO: 26314 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 26315 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26316 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26317 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26318 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 26319 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaactgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 26320 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaaccctgatgcaccagttatgttggaccaaatgttgcgtctcttggcttgttacaatatcctcacttgttcagttcgtactcaacaagatggaaagattcagagactttatggtttggctactgttgctaa

SEQ ID NO: 26321 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26322 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaaccctgatgcaccagttatgttggaccgaatgttgcgtttcttcgcttgttacaatatcctcacttgttctgttcgtactcatcaagatggaaaggttcagagactttatggtttggctactgttgctaa

SEQ ID NO: 26323 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26324 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaaccagttatgttggaccgaatgttgcgtctcttggcttgttacaatatcctcacttgttcagttcgtactcaacaagatggaaagattcagagactttatggtttggctactgttgctaa

SEQ ID NO: 26325 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaaccagttatgttggaccgaatgttgcgtctcttggcttgttacaatatcctcacttgttctgttcgtactcaacaagatggaaaggttcagagactttatggtttggctactgttgctaa

SEQ ID NO: 26326 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaaccagttatgttggaccgaatgttgcgtctcttggcttgttacaatatcctcacttgttcagttcgtactcaacaagatggaaaagttcagagactttatggtttggctactgttgctaa

SEQ ID NO: 26327 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaaccagttatgttggaccgaatgttgcgtctcttggcttgttacaatatcctcacttgttcagttcgtactcaacaagatggaaaggttcagagactttatggtttggctactgttgctaa

SEQ ID NO: 26328 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26329 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 26330 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26331 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26332 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaaggttcagagactttatagtttggctactgttgctaa

SEQ ID NO: 26333 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 26334 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26335 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacgatatcctcacttgttcagttcgtactcaacaagatggaaaagttcagagactttatggtttggctactgttgctaa

SEQ ID NO: 26336 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaaggttcagagactttatggtttggctactgtgctaa

SEQ ID NO: 26337 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaagattcagagcctttatggtttggctactgttgctaa

SEQ ID NO: 26338 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26339 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaatgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 26340 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26341 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaatgatgcaccagttatgttggaccgaatgttgcgtcgcttggcttgttacaatatcctcacttgttcagttcgcactcaacaagatggaaaggttcagagactttatggtttggctactgttgctaa

SEQ ID NO: 26342 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26343 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26344 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26345 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaaccctgatgcaccagttatgttggaccgaatgttgcgtctcttggcttgttacaatatcctcacttgttcagttcgtactcaacaagatggaaagattcagagactttatggtttggctactgttgagaa

SEQ ID NO: 26346 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 26347 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26348 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26349 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 26350 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaaatgcaccagttatgttggaccgaatgttgcgtctcttggcttgttacaatatcctcacttgttcagttcgtactcaacaggatggaaaggttcagagactttatggtttggctactgttgctaa

SEQ ID NO: 26351 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctccagttatgttggaccgaatgttgtgtctcttggcttgttacaatatcctcacttgttcagttcgtactcaacaagatggaaaggttcagagactttatggtttggctactgttgctaa

SEQ ID NO: 26352 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctccagttatgttggaccgaatgttgcgtctcttggcttgttacaatatcctcacttgttcagttcgtactcaacaagatggaaagattcagagactttatggtttggctactgttgctaa

SEQ ID NO: 26353 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctccagttatgttggaccgaatgttgcgtctcttggcttgttacaatatcctcacttgttcagttcgtactcaacaagatggaaagattcagagactttgtggtttggctactgttgctaa

SEQ ID NO: 26354 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctccagttatgttggaccgaatgttgcgtctcttggcttgttacaatatcctcacttgttcagttcgtactcaacaagatggaaaggttcagagactttatggtttggctactgttgctaa

SEQ ID NO: 26355 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctccagcggctgttgccggtgctgtgccaggcccacggcttgaccctgatgcaccagttatgttggaccgaatgttgcgtctcttggcttgttacaatatcctcacttgttcagttcgttctcaacaagatggaaaggttcagagactttatggtttggctactgttgctaa

SEQ ID NO: 26356 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26357 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctccaaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26358 - DNA, 300 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcatcctcacttgttcagttcgtactcaacaagatggaaaggttcagagactttatggtttggctactgttgctaa

SEQ ID NO: 26359 - DNA, 300 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcatcctcacttgttcagttcgtactcaacaagatggaaagattcagagactttatggtttggctactgttgctaa

SEQ ID NO: 26360 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcatcctcacttgttcagttcgtactcaacaagatggaaagattcagagactttatggtttggcactgttgctaa

SEQ ID NO: 26361 - DNA, 300 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcatcctcacttgttcagttcgtactcaacaagatggaaaagttcagagactttatggtttggctactgttgctaa

SEQ ID NO: 26362 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctatgttggaccgaatgttgcgtctcttggcttgttacaatatcctcacttgttcagttcgtactcaacaagatggaaaggttcagagactttatggtttggctactgttgctaa

SEQ ID NO: 26363 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctatgttggaccgaatgttgcgtctcttggcttgttacaatatcctcacttgttcagttcgtactcaacaagatggaaaagttcagagactttatggtttggctactgttgctaa

SEQ ID NO: 26364 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26365 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaagattcagagactttatggtttggctactgttgctaa

SEQ ID NO: 26366 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26367 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26368 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26369 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26370 - DNA, 476 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctagtccagcggctgttgccgccatcgtggctggcgatggccaccacctgctccggggtcaagccgtgggcctggcacagcaccggcaacagcgcctgcaccgtctccagcgcctgcttgccacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26371 - DNA, 476 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctagtccagcggctgttgccgccatcgtggctggcgatggccaccacctgctccggggtcaagccgtgggcctggcacagcaccggcaacagcgcctgcaccgtctccagcgcctgcttgccacccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26372 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26373 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26374 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctactgatgcaccagttatgttggaccgaatgttgcgtctcttggtttgttacaatatcctcacttgttctgttcgtactcaacaagatggaaaggttcagagactttatggtttggctactgttgctaa

SEQ ID NO: 26375 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctactgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 26376 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctactaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26377 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctgatgcaccggttatgttggaccgaatgttgcgtctcttggcttgttacaatatcctcacttgttcagttcgtactcaacaagatggaaaggttcagagactttatggtttggctactgttgctaa

SEQ ID NO: 26378 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26379 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26380 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtgctcaacaagatggaaaggttcagagactttatggtttggctactgttgctaa

SEQ ID NO: 26381 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26382 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 26383 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26384 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 26385 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 26386 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26387 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctcctgatgcaccagttatgttggaccaaatgttgcgtctcttggcttgttacaatatcctcacttgttcagttcgtactcaacaagatggaaagattcagagactttatggtttggctactgttgctaa

SEQ ID NO: 26388 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26389 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26390 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccgatgcaccagttatgttggaccgaatgttgcgtctcttggcttgttacaatatcctctcttgttcagttcgtactcaacaagatggaaaagttcagagactttatggtttggctactgttgctaa

SEQ ID NO: 26391 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26392 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 26393 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccgacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26394 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccgacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26395 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26396 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26397 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26398 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26399 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26400 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccctatgcaccagttatgttggaccgaatgttgcgtctcttggcttgttacaatatcctcacttgttcagttcgtactcaacaagatggaaagattcagagactttatggtttggctactgttgctaa

SEQ ID NO: 26401 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 26402 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26403 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26404 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaagattcagagactttatggtttggctactgttgctaa

SEQ ID NO: 26405 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccatgcaccagttatgttggaccgaatgttgcttctcttggcttgttacaatatcctcacttgttcagttcgtactcaacaagatggaaaggttcagagactttatggtttggctactgttgctaa

SEQ ID NO: 26406 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26407 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26408 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccatgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 26409 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccatgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 26410 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccatcaactatgcaccagttatgttggtccgaatgttgcgtctcttggcttgttacaatatcctcacttgttcagttcgtactcaacaagatggaaaagttcagagactttatggtttggctactgttgctaa

SEQ ID NO: 26411 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccagttatgttggaccgaatgttgcgtctcttggcttgttacaatatcctcacttgttcagttcgtactcaacaagatggaaaagttcagagactttatggtttggctactgttgctaa

SEQ ID NO: 26412 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccagttatgttggaccgaatgttgcgtctcttggcttgttacaatatcctcacttgttcagttcgtactcaacaagatggaaaggttcagagactttatggtttggctactgttgctaa

SEQ ID NO: 26413 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccagttatgttggaccgaatgttgcgtctcttggcttgttacaatatcctcacttgttcagttcgtactcaacaagatggaaagattcagagactttatggtttggctactgttgctaa

SEQ ID NO: 26414 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26415 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26416 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26417 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcggttcgtactcaacaagatggaaagattcagagactttatggtttggctactgttgctaa

SEQ ID NO: 26418 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26419 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26420 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26421 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaccgaatgttgcgtctcttggcttgttacaatatcctcacttgttcagttcgtactcaacaagatggaaaggttcagagactttatggtttggctactgttgctaa

SEQ ID NO: 26422 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaccgaatgttgcgtctcttggcttgttacaatatcctcacttgttcagttcgtactcaacaagatggaaaagttcagagactttatggtttggctactgttgctaa

SEQ ID NO: 26423 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaccgaatgttgcgtctcttggcttgttacaatatcctcacttgttcagttcgtactcaacaagatggaaagattcagagactttatggtttggctactgttgctaa

SEQ ID NO: 26424 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaccgaatgttgcgtctcttgacttgttacaatatccccacttgttcagttcgtactcaacaagatggaaaggttcagagactttatggtttggctactgttgctaa

SEQ ID NO: 26425 - DNA, 330 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgttgcgtctcttggcttgttacaatatcctcacttgttcagttcgtactcaacaagatggaaaagttcagagactttatggtttggctactgttgctaa

SEQ ID NO: 26426 - DNA, 330 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgttgcgtctcttggcttgttacaatatcctcacttgttcagttcgtactcaacaagatggaaaggttcagagactttatggtttggctactgttgctaa

SEQ ID NO: 26427 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgcaccagttatgttgggccgaatgttgcgtctcttggcttgttacaatatcctcacttgttcagttcgtactcaacaagatggaaaggttcagagactttatggtttggctactgttgctaa

SEQ ID NO: 26428 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26429 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 26430 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaagattcagagactttatggtttggctactggtgctaa

SEQ ID NO: 26431 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26432 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtacccaacaagatggaaaggttcagagactttatggtttggctactgttgctaa

SEQ ID NO: 26433 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26434 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaaccagatggaaagattcagagactttatggtttggctactgttgctaa

SEQ ID NO: 26435 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 26436 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 26437 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgatgcaccagttatgttggacctaatgttgcgtctcttggcttgttacaatatcctcacttgttcagttcgtactcaacaagatggaaaagttcagagactttatggtttggctactgttgctaa

SEQ ID NO: 26438 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26439 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26440 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26441 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26442 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26443 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatatgcaccagttatgttggaccgaatgtggcgtctcttggcttgttacaatatcctcacttgttcagttcgtactcaacaagatggaaaggttcagagactttatggtttggctactgttgctaa

SEQ ID NO: 26444 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 26445 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26446 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaataaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26447 - DNA, 413 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaagtcaagccgtgggcctggcacagcaccggcaacagccgctggaccgtctccagcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26448 - DNA, 413 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaagtcaagccgtgggcctggcacagcaccggcaacagccgctggaccgtctccagcgcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26449 - DNA, 413 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaagtcaagccgtgggcctggcacagcaccggcagcagccgctggaccgtctccagcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26450 - DNA, 413 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaagtcaagccgtggccctggcacagcaccggcaacagccgctggaccgtctccagcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26451 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26452 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26453 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggacctaatgttgcgtcgcttggcttgttacaatatcctcacttgttcagttcgtactcaacaagatggaaagattcagagactttatggtttggctactgttgctaa

SEQ ID NO: 26454 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26455 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26456 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 26457 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26458 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 26459 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26460 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgcta

SEQ ID NO: 26461 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 26462 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 26463 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttattacaatatcctcacttgttcagttcgtactcaacaagatggaaaggttcagagactttatggtttggctactgttgctaa

SEQ ID NO: 26464 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgtgacaatatcctcacttgttctgttcgtactcaacaagatggaaaggttcagagactgtatggtttggctactgttgctaa

SEQ ID NO: 26465 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggctggttacaatatcctcacttgttcagttcgtactcaacaagatggaaaggttcagagactttatggtttggctactgttgctaa

SEQ ID NO: 26466 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccaatgttgcgtctcttggcttgttacaatatcctcacttgttcagttcgtactcaacaagatggaaaggttcagagactttatggtttggctactgttgctaa

SEQ ID NO: 26467 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26468 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26469 - DNA, 342 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgttggaccgaatgttgcgtctcttggcttgttacaatatcctcacttgttcagttcgtactcaacaagatggaaaggttcagagactttatggtttggctactgttgctaa

SEQ ID NO: 26470 - DNA, 342 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgttggaccgaatgttgcgtctcttggcttgttacaatatcctcacttgttcagttcgtactcaacaagatggaaagattcagagactttatggtttggctactgttgctaa

SEQ ID NO: 26471 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 26472 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgcaccagttatgttggaccgaatgttgcgtctcttggcttgttacaatatcctcacttgttctgttcgtactcaacaagatggaaaggttcagagactttatggtttggctactgttgctaa

SEQ ID NO: 26473 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgcaccagttatgttggaccgaatgttgcgtctcttggcttgttacaatatcctcccttgttcagttcgtactcaacaaaatgtaaaggttcagagactttatggtttggctactgttgctaa

SEQ ID NO: 26474 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgcaccagttatcttggaccgaatgttgcgtctcttggcttgttacaatatcctcacttgttcagttcgtactcaacaagatggaaaggttcagagactttatggtttggctactgttgctaa

SEQ ID NO: 26475 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26476 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26477 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26478 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtacacagcaagatggaaaggttcagagcctttatggtttggctactgttgctaa

SEQ ID NO: 26479 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 26480 - DNA, 404 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgactgggcctttcgttttatctgttgtttgtcggtgaacgctctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26481 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgaccgaatgttgcgtctcttggcttgttacaatatcctcacttgttcagttcgtactcaacaagatggaaagattcagagactttatggtttggctactgttgctaa

SEQ ID NO: 26482 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgaccgaatgttgcgtctcttggcttgttacaatatcctcacttgttcagttcgtactcaacaagatggaaaggttcagagactttatggtttggctactgttgctaa

SEQ ID NO: 26483 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacctggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 26484 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26485 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26486 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26487 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctctcttgttcagttcgtactcaacaagatggaaagattcagagactttatggtttggctactgttgctaa

SEQ ID NO: 26488 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaataccctcacttgttcagttcgtactcaacaagatggaaaggttcagagactttatggtttggctactgttgctaa

SEQ ID NO: 26489 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgctaa

SEQ ID NO: 26490 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagtttgtactcaacaagatggaaagattcagagactttatggtttggctactgttgctaa

SEQ ID NO: 26491 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagtctttatggtttggctactgttgctaa

SEQ ID NO: 26492 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 26493 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggctcagagactttatggtttggctactgttgctaa

SEQ ID NO: 26494 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaccggcaagcaggcgctggagacggtccagcgcctgctgccggtgctgtgctggcgatggccaccacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26495 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaccggcaagcaggcgctggagacggtccagcgcctgctgccggtgctgtgctggcgatggccaccacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26496 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaccggcaagcagccgctggaccgtctccagcgcctgctgccggtgctgtgctggcgatggccaccacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26497 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 26498 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26499 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26500 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26501 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaagatcctcacttgttcaggtcgtacgcaacaagatggaaaggttcagagactttatggtttggctactgttgctaa

SEQ ID NO: 26502 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctaccgttgctaa

SEQ ID NO: 26503 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26504 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26505 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatttatgttggaccgaatgttgcgtctcttggcttgttacaatatcctcacttgttcagttcgtactcaacaagatggaaaggttcagagactttatggtttggctactgttgctaa

SEQ ID NO: 26506 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26507 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26508 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26509 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtacccaacaagatggaaaagttcagagactttatggtttggctactgttgctaa

SEQ ID NO: 26510 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttgctactgttgctaa

SEQ ID NO: 26511 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttctgttcgtactcaacaagatggaaaggttctgagactttatggtttggctactgttgctaa

SEQ ID NO: 26512 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 26513 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggcactgttgctaa

SEQ ID NO: 26514 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcatggcttgttacaatatcctcacttgttcagttcgtactcaacaagatggaaaggttcagagactttatggtttggctactgttgctaa

SEQ ID NO: 26515 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaagattcagagcctttatggtttggctactgttgctaa

SEQ ID NO: 26516 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggagaagttcagagactttatggtttgctactgttgctaa

SEQ ID NO: 26517 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagtcatgttggaccgaatgttgcgtctcttggcttgttacaatatcctcacttgttcagttcgtactcaacaagatggaaagattcagagactttatggtttggctactgttgctaa

SEQ ID NO: 26518 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26519 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26520 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26521 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagacttgatggtttggctactgttactaa

SEQ ID NO: 26522 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26523 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 26524 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactattgctaa

SEQ ID NO: 26525 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtattcaacaagatggaaaggttcagagactttatggtttggctactgttgctaa

SEQ ID NO: 26526 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatggtggaccgaatgttgcgtctcttggcttgttacaatatcctcacttgttcagttcgtactcaacaagatggaaagattcagagactttatggtttggctactgttgctaa

SEQ ID NO: 26527 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatctgatgcaccagttatgttgtatcgaatgttgcgtctctcggcttgctacaatatcctcacttgttcagttcgtactcaacaagatggaaaggttcagagactttatggtttggctactgttgctaa

SEQ ID NO: 26528 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 26529 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26530 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26531 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26532 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatctgatgcaccagttatgttggaccgaatgttgcgtctcttggcttgttacaatatcctcacttgttcagttcgtactcaacaagatggaaaggttcagagactttatggttttgctactgttgctaa

SEQ ID NO: 26533 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 26534 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatcagttatgttggaccgaatgttgcgtctcttggcttgttacaatatcctcacttgttctgttcgtactcaacaagatggaaaggttctgagcctttatggtttggctactgttgctaa

SEQ ID NO: 26535 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatcagttatgttggaccgaatgttgcgtctcttggcttgttacaatatcctcacttgttcagttcgtactcaacaagatggaaaggttcagagactttatggtttggctactgttgctaa

SEQ ID NO: 26536 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaggagcaggtggtggccatcgccagcaataatggtggcaagcaggcgctggagacggtccagcggctgttgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26537 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaggagcaggtggtggccatcgccagcaatattggtggcaagcaggcgctggagacggtgcaggcgctgttgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26538 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaggagcaggtggtggccatcgccagcaataatggtggcaagcaggcgctggagacggtccagcggctgttgccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26539 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaggagcaggtggtggccatcgccagcaataatggtggcaagcaggcgctggagacggtccagcggctgttgccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 26540 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaggagcaggtggtggccatcgccagcaatattggtggcaagcaggcgctggagacggtgcaggcgctgttgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26541 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacagcctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 26542 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26543 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26544 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 26545 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggcctactgttgctaa

SEQ ID NO: 26546 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacagatgcaccagtcatgttggaccgaatgttgcgtctcttggcttgttacaatatcctcacttgttcagttcgtactcaacaagatggaaaggttcagagcctttatggtttggctactgttgctaa

SEQ ID NO: 26547 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacagatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 26548 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26549 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgatacaatatcctcacttgttcagttcgtactcaacaagatggaaaggttcagagactttatggtttggctactgttgctaa

SEQ ID NO: 26550 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26551 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttctgttcgtactcaacaagatggaaagattcagagactttatggtttggctactgttgctaa

SEQ ID NO: 26552 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaagttcagagactttatggttggctactgttgctaa

SEQ ID NO: 26553 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 26554 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatgaaaagattcagagactttatggtttggctactgttgctaa

SEQ ID NO: 26555 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26556 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 26557 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 26558 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcatactcaacaagatggaaaagttcagagactttatggtttggctactgttgctaa

SEQ ID NO: 26559 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 26560 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 26561 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 26562 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 26563 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacacgcaccagttatgttggaccgaatgttgcgtctcttggcttgttacaatatcctcacttgttcagttcgtactcaacaagatggaaaggttcagagactttatggtttggctactgttgctaa

SEQ ID NO: 26564 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26565 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26566 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26567 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26568 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaccctgatgcaccagttatgttggaccgaatgttgcgtctcttgggtggttacaatatcctcacttgttcagttcgtactcaacaagatggaaaagttcagagactttatggtttggctactgtagctaa

SEQ ID NO: 26569 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26570 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26571 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacacccctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 26572 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 26573 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaagattcagagactttatggtttggctactgttgctaa

SEQ ID NO: 26574 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaccagttatgttggaccgaatgttgtgtctcttggcttgttacaatatcctcacttgttcagttcgtactcaacaagatggaaaagttcagagactttatggtttggctactgttgctaa

SEQ ID NO: 26575 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaagttcagagactttatggtttggctactgttgctaa

SEQ ID NO: 26576 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggtacagagactttatggtttggctactgttgctaa

SEQ ID NO: 26577 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagctcgtactcaacaagatggaaaggttcagagactttatggtttggctactgttgctaa

SEQ ID NO: 26578 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaattttatgttggaccgaatgttgcgtctcttggcttgttacaatatcctcacttgttcagttcgtactcaacaagatggaaagattcagagactttatggtttggctactgttgctaa

SEQ ID NO: 26579 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaattgcaccagttatgttggaccgaatgttgcgtctcttggcttgttacaatatcctcacttgttcagttcgtactcaacaagatggaaagattcagagactttatggtttggctactgttgctaa

SEQ ID NO: 26580 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaattgcaccagttatgttggaccgaatgttgcgtctcttggcttgttacaatatcctcacttgttcagttcgtactcaacaagatggaaaggttcagagactttatggtttggctactgttgctaa

SEQ ID NO: 26581 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaattgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26582 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaattatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26583 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaattatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26584 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaattatgcaccagttatgttggaccgaatgttgcgtctcttggcttgttacaatatcctcacttgttcagttcgtactcaacaagatggaaaagttcagagactttatggtttggatactgtggagaa

SEQ ID NO: 26585 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaattatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26586 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26587 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttgctactgttgctaa

SEQ ID NO: 26588 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26589 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgtttcgtctcttggcttgttacaatatcctcacttgttctgttcgtactcaacaagatggaaaggttcagagactttatggtttggctactgtggctaa

SEQ ID NO: 26590 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggcactgttgctaa

SEQ ID NO: 26591 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26592 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 26593 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcatttgttcagttcgtactcaacaagatggaaaggttcagagactttatggtttggctactgttgctaa

SEQ ID NO: 26594 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagggactttatggtttggctactgtgctaa

SEQ ID NO: 26595 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctatgttgctaa

SEQ ID NO: 26596 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagagggaaagattcagagactttatggtttggctactgttgctaa

SEQ ID NO: 26597 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 26598 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaaccagatggaaagattcagagactttatggtttggctactgttgctaa

SEQ ID NO: 26599 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttagaccgaatgttgcgtctcttggcttgttacaatatcctcacttgttcagttcgtactcaacaagatggaaagattcagagactttatggtttggctactgttgctaa

SEQ ID NO: 26600 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 26601 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26602 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26603 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaagattcagagactttatggtttggctactgttgcta

SEQ ID NO: 26604 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26605 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26606 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggacagaatgttgcgtctcttggcttgttacaatatcctcacttgttcagttcgtactcaacaagatggaaaggttcagagactttatggtttggctactgttgctaa

SEQ ID NO: 26607 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcatactcaacaagatggaaaggttcagagactttatggtttggctactgttgctaa

SEQ ID NO: 26608 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgtcgcgtctcttggcttgttacaatatcctcacttgttcggttcgtactcaacaagatggaaaggttcagagactttatggtttggctactgttgctaa

SEQ ID NO: 26609 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 26610 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtacgcaacaagatggaaagattcagagactttatggtttggctactgttgctaa

SEQ ID NO: 26611 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26612 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26613 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaagattcagagactatatggtttggctactgttgctaa

SEQ ID NO: 26614 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26615 - DNA, 335 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatatgttgcgtctcttggcttgttacaatatcctcacttgttcagttcgtactcaacaagatggaaaggttcagagactttatggtttggctactgttgctaa

SEQ ID NO: 26616 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26617 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttattgtttggctactgttgctaa

SEQ ID NO: 26618 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 26619 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctctcttgttcagttcgtactcaacaagatggaaaggttcagagactttatggtttggctactgttgtaa

SEQ ID NO: 26620 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaagattcagagactttatggtttggctactgttgataa

SEQ ID NO: 26621 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaagcaccagttatgttggaccgaatgttgcgtctcttggcttgttacaatatcctcacttgttcagttcgtactcaacaagatggaaaggttcagagacttcatggtttggctactgttgctaa

SEQ ID NO: 26622 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaagcaccagttatgttggaccgaatgttgcgtctcttggcttgttacaatatcctcacttgttcagttcgtactcaacaagatggaaaggttcagagactttatggtttggctactgttgctaa

SEQ ID NO: 26623 - DNA, 277 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaagatggaaagattcagagactttatggtttggctactgttgctaa

SEQ ID NO: 26624 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26625 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26626 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 26627 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaagatgcaccagttatgttggaccgaatgttgcgtcgcttggcttgttacaatatcctcacttgttcagttcgtactcaacaagatggaaaagttcagagactttatggtttggctactgttgctaa

SEQ ID NO: 26628 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgcta

SEQ ID NO: 26629 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaagatgcaccagttatgttggaccgaatgtggcgtctcttggcttgttacaatatcctcacttgttcagttcgtactcaacaagatggaaaggttcagagactttatggtttggctactgttgctaa

SEQ ID NO: 26630 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaagatgcaccagttatgttggaccgaatgttgcgtctcttgacttgttacaatatcctcacttgttcagttcgtactcaacaagatggaaagattcagagactttatggtttggctactgttgctaa

SEQ ID NO: 26631 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttctgttcgtactcaacaagatggaaaagttcagagactttatggtttggctactgttgctaa

SEQ ID NO: 26632 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaagttcagagactttatggtttggctactgtgctaa

SEQ ID NO: 26633 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaagatgcaccagttatgttggacagaatgttgcgtctcttggcttgttacaatatcctcactagttcagttcgtactcaacaagatggaaaggttcagagactttatggtttggctactgttgctaa

SEQ ID NO: 26634 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactttatgttggaccgaatgttgcgtctcttggcttgttacaatatcctcacttgttcagttcgtactcaacaagatggaaagattcagagactttatggtttggctactgttgctaa

SEQ ID NO: 26635 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactttatgttggaccgaatgttgcgtctcttggcttgttacaatatcctcacttgttcagttcgtactcaacaagatggaaaggttcagagactttatggtttggctactgttgctaa

SEQ ID NO: 26636 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgcgtctcttggcttgttacaatatcctcacttgttcagttcgtactcaacaagatggaaaggttcagagactttatggtttggctactgttgctaa

SEQ ID NO: 26637 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgcgtctcttggcttgttacaatatcctcacttgttcagttcgtactcaacaagatggaaagattcagagactttatggtttggctactgttgctaa

SEQ ID NO: 26638 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgcgtctcttggcttgttacaatatcctcacttgttcagttcgtactcaacaagatggaaaggttgagagcctttatggtttggatactgttgctaa

SEQ ID NO: 26639 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgcgtctcttggcttgttacaatatcctcacttgttctgttcgtactcaacaagatggaaagattcagagactttatggtttggctactgttgctaa

SEQ ID NO: 26640 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgcaccagttatgttggatcgaatgttgcgtcgcttggcttgttacaatatcctcacttgttcagttcgtactcaacaagatggaaaggttcagagactttatggtttggctactgttgctaa

SEQ ID NO: 26641 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaaggttcagagactttatggtttggctactgttgctaa

SEQ ID NO: 26642 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaagattcagagactttatggtttggctactgttgctaa

SEQ ID NO: 26643 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttctgttcgtactcaacaagatggaaaggttcagagactttatggtttggctactgttgctaa

SEQ ID NO: 26644 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaaagttcagagactttatggtttggctactgttgctaa

SEQ ID NO: 26645 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgatgcaccagttgtgttggaccgaatgttgcgtctcttggcttgttacaatatcctcacttgttcagttcgtactcaacaagatggaaaggttcagagactttatggtttggctactgttgctaa

SEQ ID NO: 26646 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26647 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatgggttggctactgtttgctaa

SEQ ID NO: 26648 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26649 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26650 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgatgcaccagttatgttggaccgaatgttgcgactcttggcttgttacaatatcctcacttgttcagttcgtactcaacaagatggaaagattcagagactttatggtttggctactgttgctaa

SEQ ID NO: 26651 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaagttcagagactttatggtttggctactgttgctaa

SEQ ID NO: 26652 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaggttcagagactttatggtttggctactgttgctaa

SEQ ID NO: 26653 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaagattcagagactttatggtttggctactgttgctaa

SEQ ID NO: 26654 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttctgttcgtactcaacaagatggaaaggttcagagactttatggtttggctactgttgctaa

SEQ ID NO: 26655 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttctgttcctactcaacaagatggaaaggttcagagactttatggtttggctactgttgctaa

SEQ ID NO: 26656 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaagttcagagcctttatggtttggctactgttgctaa

SEQ ID NO: 26657 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttatcttcgagccagccacgatcgacattgatctgtgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26658 - DNA, 421 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttatcgactcaactatcagaggtagttggcgtcatcgagcgccatctcgaaccgacgttgctggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 26659 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgtcaggatggccttctgcttagtttgatgcctggcagtttatggcgggcgtcctgcccgccaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26660 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactggtccagcgcctgcttgccaccattattgctggcgagggccaccccctgctggggggtcaagccgtgggcctggcacagcaccggcaacagccgctggaccgtctccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 26661 - DNA, 404 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgggcatttcgttttatctgttgtttgtcgatgaacgctctccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26662 - DNA, 478 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactggcgatggccaccacctgcgcgggggtcaagccgtggccctgccacagcaccggcaccagccgctggaccgtctccagcgcctgcttgccgccatcgtggctggcgatggccacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26663 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactggcacagcaccggcaacagccgctggaccgtctccagcaacagttatgttggaccgaatgttgcgtctcttggcttgttacaatatcctcacttgttcagttcgtactcaacaagatggaaaggttcagagactttatggtttggctactgttgctaa

SEQ ID NO: 26664 - DNA, 391 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactggcacagcaccggcaacagccgctggaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26665 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactggcacagcaccggcaacagccgctggaccgtctccagcaccagttatgttggaccgaatgttgcgtctcttggcttgttacaatatcctcacttgttcagttcgtactcaacaagatggaaaggttcagagactttatggtttggctactgttgctaa

SEQ ID NO: 26666 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgcgctggagacggtgcaggcgctgttgccggtgctgtgccaggcccacggcttgaccccccagcaggtggtggccatcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26667 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgcgctggagacggtccaggcgctgttgccggtgctgtgccaggcccacggcttgaccccccagcaggtggtggccatcgccctgatgcaccagttatgttggaccgaatgttgcgtctcttggcttgttacattatcctcacttgttcagttcgtactcaacaagatggaaaagttcagagactttatggtttggctactgttgctaa

SEQ ID NO: 26668 - DNA, 448 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgccggtgctgtgccaggcccacggcttgaccccggagcaggtggtggccatcgccagcaatagtggtggcaagcaggcgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26669 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgcaccagttatgttggaccgaatgttgcgtctcttggcttgttacaatatcctcacttgttcagttcgtactcaacaagatggaaaggttcagagactttatggtttggctactgttgctaa

SEQ ID NO: 26670 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgcaccagttatgttggaccgaatgttgcgtctcttggcttgttacaatatcctcacttgttcagttcgtactcaacaagatggaaagattcagagactttatggtttggctactgtggctaa

SEQ ID NO: 26671 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgcaccagttatgttggaccgaatgttgcgtctcttggcttgttacaatatcctcacttgttcagttcgtactcaacaagatggaaagattcagagactttatggtttggctactgttgctaa

SEQ ID NO: 26672 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatttgtcctactcaggagagcgttcaccgacaaacaacagataaaacgaaaggcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26673 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 26674 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgtaccagttatgttggaccgaatgttgcgtctcttggcttgttacaatatcctcacttgttcagttcgtactcaacaagatggaaagattcagagactttatggtttggctactgttgctaa

SEQ ID NO: 26675 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttttgttggaccgaatgttgcgtctcttggcttgttacaatatcctcacttgttcagttcgcactcaacaagatggaaaggttcagagactttatggtttggctactgttgctaa

SEQ ID NO: 26676 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttgggccgaatgttgcgtctcttggcttgttacaatatcctcacttgttcagttcgtactcaacaagatggaaaggttcagagactttatggtgtggctactgttgctaa

SEQ ID NO: 26677 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 26678 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26679 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26680 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26681 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 26682 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26683 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagctcgtactcaacaagatggaaagattcagagactttatggtttggctactgttgctaa

SEQ ID NO: 26684 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaac

SEQ ID NO: 26685 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaagattcagagactttatggtttggctatgttgctaa

SEQ ID NO: 26686 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaaggttcagagactttatggtttggctactgttgctaa

SEQ ID NO: 26687 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaaa

SEQ ID NO: 26688 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaacgaatgttgcgtctcttggcttgttacaatatcctcacttgttcagttcgtactcaacaagatggaaaggttcagagactttatggtttggctactgttgctaa

SEQ ID NO: 26689 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttagggtttggctagttgctaa

SEQ ID NO: 26690 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttaccatatcctcacttgttcagttcgtactcaacaagatggaaaggttcagagactttatggtttggctactgttgctaa

SEQ ID NO: 26691 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 26692 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgcatgttgcgtctcttggcttgttacaatatcctcacttgttcagttcgtactcaacaagatggaaaggttcagagactttatggtttggctactgttgctaa

SEQ ID NO: 26693 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcatactcaacaagatggaaaagttcagagactttatggtttggctactgttgctaa

SEQ ID NO: 26694 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgtacaatatcctcacttgttcagttcgtactcaacaagatggaaaggttcagagactttatggtttggctactgttgctaa

SEQ ID NO: 26695 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgtttcgtctcttggcttgttacaatatcctcacttgttcagttcgtactcaacaagatggaaaggttcagagactttatggtttggctactgttgctaa

SEQ ID NO: 26696 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacattatcctcacttgttcagttcgtactcaacaagatggaaaggttcagagactttatggtttggctactgttgctaa

SEQ ID NO: 26697 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttagggtttggctactgttgctaa

SEQ ID NO: 26698 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgcta

SEQ ID NO: 26699 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggatcgaatgttgcgtctcttggcttgttacaatatcctcacttgttctgttcgtactcaacaagatggaaagattcagagactttatggtttggctactgttgctaa

SEQ ID NO: 26700 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtcgcttggcttgttacaatatcctcacttgttcagttcgtactcaacaagatggaaaagttcagagactttatggtttggctactgttgctaa

SEQ ID NO: 26701 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttgctacgttgctaa

SEQ ID NO: 26702 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgtgcgtactcaacaagatggaaaggttcagagactttatggtttggctactgttgctaa

SEQ ID NO: 26703 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcttactcaacaagatggaaaggttcagagactttatggtttggctactgttgctaa

SEQ ID NO: 26704 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaagattcagagactttatggtttggctactgttgctaa

SEQ ID NO: 26705 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccaaatgttgcgtctcttggcttgttacaatatcctcacttgttcagttcgtactcaacaagatggaaaagttcagagactttatggtttggctactgttgctaa

SEQ ID NO: 26706 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgttctcaacaagatggaatggttcagagacattatggtttggctactgttgctaa

SEQ ID NO: 26707 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 26708 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 26709 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgtttaa

SEQ ID NO: 26710 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 26711 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcactttttcagttcgtactcaacaagatggaaagattcagagactttatggtttggctactgttgctaa

SEQ ID NO: 26712 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactttgctaa

SEQ ID NO: 26713 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 26714 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctac

SEQ ID NO: 26715 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtcgcgtggcttgttacaatatcctcacttgttcagttcgtactcaacaagatggaaaggttcagagactttatggtttggctactgttgcgaa

SEQ ID NO: 26716 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 26717 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 26718 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggacctaatgttgcgtctcttggcttgttacaatatcctcacttgttcagttcgtactcaacaagatggaaaggttcagagactttatggtttggctactgttgctaa

SEQ ID NO: 26719 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 26720 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgtggctaa

SEQ ID NO: 26721 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacgatatcctcacttgttcagttcgtactcaacaagatggaaagattcagagactttatggtttggctactgttgctaa

SEQ ID NO: 26722 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgctgctaa

SEQ ID NO: 26723 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagtccgtactcaacaagatggaaagattcagagactttatggtttggctactgttgctaa

SEQ ID NO: 26724 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcactttttcagttcgtactcaacaagatggaaaggttcagagactttatggtttggctactgttgctaa

SEQ ID NO: 26725 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 26726 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 26727 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 26728 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttcctaa

SEQ ID NO: 26729 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgatggaccgaatgttgcgtctcttggcttgttacaatatcctcacttgttcagttcgtactcaacaagatggaaaggttcagagactttatggtttggctactgttgctaa

SEQ ID NO: 26730 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 26731 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 26732 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccaattatgttggaccgaatgttgcgtctcttggcttgttacaatatcctcacttgttcagttcgtactcaacaagatggaaaagttcagagactttatggtttggctactgttgctaa

SEQ ID NO: 26733 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgacggatggcctttttgcgtttctacaaactcttcctggctagcggtgccctgatgcaccagttatgttggaacgaatgtggcgtctcttggcttgttacaatatcctcacttgttgagttcgtactcaacaagatggaaagattcagagactttatggtttggctactgttgctaa

SEQ ID NO: 26734 - DNA, 402 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgaagaagatcgcttggcctcgcgcgcagatcagttggaagaatttgtccactacgtgaaaggcgagatcaccaatctcttggcttgttacaatatcctcacttgttcagttcgtactcaacaagatggaaaggttcagagactttatggtttggctactgttgctaa

SEQ ID NO: 26735 - DNA, 402 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgaagaagatcgcttggcctcgcgcgcagatcagttggaagaatttgtccactacgtgaaaggcgagatcaccaatctcttggcttgttacaatatcttcacttgttcagttcgtactcaacaagatggaaagattcagagactttatggtttggctactgttgctaa

SEQ ID NO: 26736 - DNA, 402 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgaagaagatcgcttggcctcgcgcgcagatcagttggaagaatttgtccactacgtgaaaggcgagatcaccaatctcttggcttgttacaatatcctcacttgttcagttcgtactcaacaagatggaaagattcagagactttatggtttggctactgttgctaa

SEQ ID NO: 26737 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26738 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26739 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26740 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 26741 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgagtgttgcgtctcttggcttgttacaatatcctcacttgttcagttcgtactcaacaagatggaaaagttcagagactttatggtttggctactgttgctaa

SEQ ID NO: 26742 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 26743 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctctaggcttgttacaatatcctcacttgttcagttcgtactcaacaagatggaaaggttcagagactttatggtttggctactgttgcta

SEQ ID NO: 26744 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26745 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgtcacaatatcctcacttgttcagttcgtactcaacaagatggaaaagttcagagactttatggtttggctactgttgctaa

SEQ ID NO: 26746 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgtgacaatatcctcacttgttcagttcgtactcaacaagatggaaagattcagagactttatggtttggctactgttgctaa

SEQ ID NO: 26747 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactctccaggggaagccgaagtttccaaaaggtcgttgatcaaagctcgccgcgttgtttcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26748 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcgtaaccgtatcgatatgctctcaaccggcattaaaagcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26749 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcgtaaccgtatcgatatgctctcaaccggcattaaaagcccctgatgcaccagttatgttggaccgaatgttgcgtctcttggcttgttacaatatcctcacttgtccagttcgtactcaacaagatggaaaggttcagagactttatggtttggctactgttgctaa

SEQ ID NO: 26750 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26751 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26752 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttctgttcgtactcaacaagatggaaaggttcagagactttatggtttggctattgctaa

SEQ ID NO: 26753 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagttggaaaggttcagagactttatggtttggctactgttgctaa

SEQ ID NO: 26754 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26755 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26756 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcctgatgcaccagttatgttggaccgaatgttgcgtcgcttggcttgttacaatatcctcacttgttcggttcgtactcaacaagatggaaaggttcagagactttatggtttggctactgttgctaa

SEQ ID NO: 26757 - DNA, 466 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactccgtctccagcgcctgcttgccgccatcggggctggcggtgcccaccccctgccccggggtcaagccgtgggcctggcacagcaccggcaacagccgctggaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26758 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26759 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactccctgatgcaccagttatgttggaccgaatgttgcgtctcttggcttgttacaatatcctcacttgttcagttcgtactcaacaagatggaaaggttcagagactttattgtttggctactgttgctaa

SEQ ID NO: 26760 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcattgccaaatgtttgaacgatcgcgccctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26761 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26762 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttcaatatcctcacttgttcagttcgtactcaacaagatggaaagattcagagactttatggtttggctactgttgctaa

SEQ ID NO: 26763 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26764 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaagattcagagactttatggtttggctactgttgctaa

SEQ ID NO: 26765 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26766 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26767 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttctgttcgtactcaacaagatggaaaggttcagagactttatggtttggctacctgttgctaa

SEQ ID NO: 26768 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaagattcagagactttatggtttggctactgttgctaa

SEQ ID NO: 26769 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcgtggcttgttacaatatcctcacttgttcagttcgtactcaacaagatggaaaggttcagagactttatggtttggctactgttgctaa

SEQ ID NO: 26770 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26771 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgcta

SEQ ID NO: 26772 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 26773 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactataccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26774 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaggcggatttgtcctactcaggagagcgttcaccgacaaacaacagataaaacgaaaggctcagtatgcaccagttatgttggaccgaatgttgcgtctcttggcttgttacaatatcctcacttgttcagttcgtactcaacaagatggaaagattcagagactttatggtttggctactgttgctaa

SEQ ID NO: 26775 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaggcggatttgtcctactcaggagagcgttcaccgacaaacaacagataaaacgaaaggctcagtatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26776 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaggcggatttgtcctactcaggagagcgttcaccgacaaacaacagataaaacgaaaggctcagtatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 26777 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaggcaacagcgcctgcaccgtctccagcgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26778 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaggcaacagcgcctgcaccgtctccagcgccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26779 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaggcaacagcgcctgcaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26780 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaggcaacagcgcctgcaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26781 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaggcaacagcgcctgcaccggcgccagcgccctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 26782 - DNA, 441 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaggacaggtatccggtaagcggcagggtcggaacaggagagcgcacgagggagcttccagggggaaacgcctggtatctttaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26783 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactagcgtgaccgagttcaagttcctgttcgtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26784 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactagcgtgaccgagttcaagttcctgttcgtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26785 - DNA, 465 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactagcccacggcttgaccccccagcgggtggtggccatcgccagccacgatggcggcaagcaggcgctgggagaggcggtttgcgtattgggcgctcttccgcttctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26786 - DNA, 465 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactagcccacggcttgaccccccagcaggtggtggccatcgccagccacgatggcggcaagcaggcgctgggagaggcggtttgcgtattgggcgctcttccgcttctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26787 - DNA, 465 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactagcccacggcttgaccccccagcaggtggtggccatcgccagccacgatggcggcaagcaggcgctgggagaggcggtttgcgtattgggcgctcttccgcttctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26788 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactagccaggcccacggcttgaccctgatgcaccagttatgttggaccgaatgttgcgtctcttggcttgttacaatatcctcacttgttcagttcgtactcaacaagatggaaaagttcagagactttatggtttggctactgtggctaa

SEQ ID NO: 26789 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactagccaggcccacggcttgaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26790 - DNA, 382 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactagccaggcccacggcttgaccctgatgcaccagttatgttggaccgaatgttgcgtctcttggcttgttacaatatcctcacttgttcagttcgtactcaacaagctggaaaggttcagagactttatggtttggctatgttgctaa

SEQ ID NO: 26791 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactagccaggcccacggcttgaccctgatgcaccagttatgttggaccgaatgttgcgtctcttggcttgttacaatatcctcacttgttcagttcgtactcaacaagatggaaaagttcggagcctttatggtttggctactgttgctaa

SEQ ID NO: 26792 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactagccaccctccgggccgttgcttcacaacgttcaaatccgctcccggcggatttgtcctactcaggagagcgttcaccgacaaacaacagataaaacgaaaggcccactgatgcaccagttatgttggaccgaatgttgcgtctcttggcttgttacaatatcctcacttgttcagttcttactcaacaagatggaaagattcagagactttatggtttggctactgttgctaa

SEQ ID NO: 26793 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactagcaccagttatgttggaccgaatgttgcgtctcttggcttgttacaatatcctcacttgttcagttcgtactcaacaagatggaaaggttcagagactttatggtttggctactgttgctaa

SEQ ID NO: 26794 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26795 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26796 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26797 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactacggctacactagaagagcagtatttggtatctgcgctctgctgaagccagttaccttcggaaaaagagttggtagctcttgatccggcaaacaaaccaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26798 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactacggctacactagaagaacagtatttggtatctgcgctctgctgaagccagttaccttcggaaaaagagttggtagctcttgatccggcaaacaaaccaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26799 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactacggctacactagaagaacagtatttggtatctgcgctctgctgaagccagttaccttcggaaaaagagttggtagctcttgatccggcaaacaaaccaccgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26800 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactacctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 26801 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26802 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26803 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaggttcagagactttatggtttggcta

SEQ ID NO: 26804 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 26805 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaccggcaacagccgctggaccgtctccagcaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26806 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26807 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26808 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26809 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcatggcttgttacaatatcctcacttgttcagttcgtactcaacaagatggaaaggttcagagactttatggtttggctactgttgctaa

SEQ ID NO: 26810 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaccctgatacaccagttatgttggaccgaatgttgcgtctcttggcttgttacaatatcctcacttgttcagttcgtactcaacaagatggaaaggttcagagactttatgggttggctactgttgctaa

SEQ ID NO: 26811 - DNA, 430 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactacccacggcttgaccccggggcggggggtggccatcgccagccacgatggcggcaagcaggcgctggactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26812 - DNA, 430 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactacccacggcttgaccccggagcaggtggtggccatcgccagccacgatggcggcaagcaggcgctggactgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 26813 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaattttattttgactgatagtgacctgttcgttgcaacaaattgataagcaatgctttcttataatgccaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26814 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaattttattttgactgatagtgacctgttcgttgcaacaaattgataagcaatgctttcttataatgccaacgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26815 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaatgcaccagttatgttggaccgaatgttgcgtctattggcttgttacaatatcctcacttgttcagttcgtactcaacaagatggaaagattcagagactttatggtttggctactgttgctaa

SEQ ID NO: 26816 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 26817 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26818 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaatgcaccagtcatgttggaccgaatgttgcgtctcttggcttgttacaatatcctcacttgttcagttcgtactcaacaagatggaaagattcagagactttatggtttggctactgttgctaa

SEQ ID NO: 26819 - DNA, 446 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaatatattatgctagtaaataccaacatataacataacaaaataccactcaacaaaatatactaactaaattataaaaagacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26820 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaggcgctggagacggtccagcggctgttgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26821 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaggcgctggagacggtccagcggctgttgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26822 - DNA, 397 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaggcgcagcggtcgggctgaacggggggttaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26823 - DNA, 457 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaagcggctgttgccggtgctgggccaggcccacggctggaccccggagcaggtggtggccatcgccagccacgatggcggcaagcaggcgctggactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26824 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaagccgtgggcctggcccagcaccggcaacagccgctggaccgtctccagcgcctgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26825 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaagccgtgggcctggcccagcaccggcaacagccgctggaccgtctccagcgcctgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26826 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaagccgtgggcctggcacagccccggcaacagccgctggaccgtctccagcgcctgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26827 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaagccgtgggcctggcacagcaccggcaacagccgctggaccgtctccagcgcctgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26828 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaagccgtgggcctggcacagccccggcaacagccgctggaccgtctccagcgcctgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26829 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaagccgtgggcctggcacagcaccggcaacagccgctggaccgtctccagcgcctgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26830 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaagccgtgggcctggcacagcaccggaaccagccgctggaccgtctccagcgcctgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26831 - DNA, 388 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaagccagttaccttcggaaaaagagtctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26832 - DNA, 387 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaagccagttaccttcggaaaaagagtctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 26833 - DNA, 388 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaagccagttaccttcggaaaaagagtctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26834 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaagcaccagttatgttggaccgaatgttgcgtctcttggcttgttacaatatcctcacttgttcagttcgtactcaacaagatggaaaggttcagagactttatggtttggctactgttgctaa

SEQ ID NO: 26835 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaagcaccagttatgttggaccgagtgttgcgtctctggggttgttacaatatcctcacttgttcagttcgtccgcaacaagatggaaagattcagagactttatggttgggctactgttgctaa

SEQ ID NO: 26836 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaactccatcgcctgcttgccgcgttggtggcggtgatgctccagttatgttggaccgattgttgagtctcttggcttgtgacaatatcctcactgttccagtccttacccaacaagatggaaaggttcagagactgtatggtttggcgactgttgctaa

SEQ ID NO: 26837 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaactccagcgcctgcttgccaccatcgtggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26838 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaactccagcgcctgcttgccgccatcgtggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26839 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaactccagcgcctgcttgccgccatcgtggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26840 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 26841 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacgcaccagttatgttggaccgaatgttgcgtctcttggcttgttacaatatcctcacttgttcagttcgtactcaacaagatggaaaagttcagagactttatggtttggctactgttgctaa

SEQ ID NO: 26842 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26843 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26844 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26845 - DNA, 366 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaagttcagagactttatggtttggctactgttgcttaa

SEQ ID NO: 26846 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26847 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacctatgttggaccgaatgttgcgtctcttggcttgttacaatatcctcacttgttctgttcgtactcaacaagatggaaaggttcagagactttatggtttggctactgttgctaa

SEQ ID NO: 26848 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacctatgttggaccgaatgttgcgtctcttggcttgttacaatatcctcacttgttcagttcgtactcaacaagatggaaaggttcagagactttatggtttggctactgttgctaa

SEQ ID NO: 26849 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacctatgttggaccgaatgttgcgtctcttggcttgttacaatatcctcacttgttcagttcgtactcaacaagatggaaaagttcagagactttatggtttggctactgttgctaa

SEQ ID NO: 26850 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacctatgttggaccgaatgttgcgtctcttggcttgttacaatatcctcacttgttcagttcgtacccaacaagatggaaaggttcagagactttatggtttggctactgttgctaa

SEQ ID NO: 26851 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccggtgctgtgccaggcccacggcttgaccccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26852 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccggtgctgtgccaggcccacggcttgaccccggagcaggtggctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26853 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccggcaacagcgcctgcaccgtctccagcgcctgcttgccaccaatattgctggcgatggccctgatgtaccagttatgttggaccgaatgttgcgtctcttggcttgttacaatatcctcacttgttctgttcgtactcaacaagatggaaaggttcagagactttatggtttggctactgttgctaa

SEQ ID NO: 26854 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccggcaacagcgcctgcaccgtctccagcgcctgcttgccaccaatattgctggcgatggccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26855 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccggcaacagcgcctgcaccgtctccagcgcctgcttgccaccaatattgctggcgatggccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26856 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccgcaaaaaggccatccgtcaggatggccttctgcttagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26857 - DNA, 428 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccgaacaggcttatgtccactgggttcgtgtggtggccatcgccagccacgatggcggcaagcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26858 - DNA, 428 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccgaacaggcttatgtccactgggttcgtgtggtggccatcgccagccacgatggcggcaagcactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26859 - DNA, 440 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctggaggaggtgaggaggaagttcaacaacggcgagatcaacttcgcggccgactgataactcgagaagggcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26860 - DNA, 440 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctggaggaggtgaggaggaagttcaacaacggcgagatcaacttcgcggccgactgataactcgagaagggcgcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26861 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26862 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccgtgggcctggcacagcaccggcaacagcgccctgatgcaccagttatgttggaccgaatgttgcgtctcttggcttgttacaatatcctcacttgttcagttcgtactcaacgagatggaaaagttcagagactttatggtttggctactgttgctaa

SEQ ID NO: 26863 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccgtgggcctggcacagcaccggcaacagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26864 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccgtgggcctggcacagcaccggcaacagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26865 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccgtgggcctggcacagcaccggcaacagcgccctgatgtaccagttatgttggaccgaatgttgcgtctcttggcttgttacaatatcctcacttgttcagttcgtactcaacaagatggaaagattcagagactttatggtttggctactgttgctaa

SEQ ID NO: 26866 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccgctggaccgtctccagcgcctgcttgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26867 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccgctggaccgtctccagcgcctgcttgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26868 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccgctggaccgtctccagcgcctgcttgccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 26869 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccgctggaccgtctccagcgcctgcttgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26870 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccgctggaccgtctccagcgcctgcttgccctgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 26871 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26872 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26873 - DNA, 474 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccccggagcagtgggtggccatcgccagccacgatggcggcaagcaggcgctggagacggtccagcggctgttgccggtgctgtgccaggcccacggcttgaccccccagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26874 - DNA, 472 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccccggagcaggtggtggccatcgccagcaatattggtggcaagcaggcgctggagacggtgcaggcgctgttgccggtgctgtgccaggcccacggcttgaccccccagcatgcaccagttatgttggaccgaatgttgcgtctcttggcttgttacaatatcctcacttgttcagttcgtactcaacaagatggaaagattcagagactttatggtttggctactgttgctaa

SEQ ID NO: 26875 - DNA, 474 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccccggagcaggtggtggccagcgccagcaatattggtggcaagcaggcgctggagacggtgcaggcgctgttgccggtgctgtgccaggcccacggcttgaccgtctccagcatgcaccagttatgttggaccgaatgttgcgtctcttggcttgttacaatatcctcacttgttcagttcgtactcaacaagatggaaagattcagagactttatggtttggctactgttgctaa

SEQ ID NO: 26876 - DNA, 474 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccccggagcaggtggtggccatcgccagcaatattggtggcaagcaggcgctggagacggtgcaggcgctgttgccggtgctgtgccaggcccacggcttgaccgtctccagcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26877 - DNA, 368 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26878 - DNA, 369 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26879 - DNA, 369 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26880 - DNA, 388 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccccagcgcctgcttgccaccgccacatgcaccagttatgttggaccgaatgttgcgtctcttggcttgttacaatatcctcacttgttcagttcgtactcaacaagatggaaagattcagagactttatggtttggctactgttgctaa

SEQ ID NO: 26881 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccatatttttttattttttttatttttcaaacctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 26882 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccatatttttttattttttttatttttcaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26883 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagttcgtactcaacaagatggaaaggttcagagactttatggtttggctactgttgctaa

SEQ ID NO: 26884 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttctgttcgtactcaacaagatggaaaggttcagagactttatggtttggctactgttgctaa

SEQ ID NO: 26885 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagttcgtactcaacaagatggaaaagttcagagactttatggtttggctactgttgctaa

SEQ ID NO: 26886 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagttcgtactcaacaagatggaaagattcagagactttatggtttggctactgttgctaa

SEQ ID NO: 26887 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagctcgtactcaacaagatggaaaagttcagagactttatggtttggctactgttgctaa

SEQ ID NO: 26888 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccaccctccgggccgttgctttacaacgttcaaatccgctcccggcggatttgtcctactcaggagagcgttcaccgacaaacaacagataaaacgaaaggctcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26889 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccaccctccgggccgttgcttcacaacgttcaaatccgctcccggcggatttgtcctactcaggagagcgttcaccgacaaacaacagataaaacgaaaggctcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26890 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccaccagttatgttggaccgaatgttgcgtctcttggcttgttacaatatcctcacttgttcagttcgtactcaacaagatggaaaagttcagagactttatggtttggctactgttgctaa

SEQ ID NO: 26891 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccaccagttatgttggaccgaatgttgcgtctcttggcttgttacaatatcctcacttgttcagttcgtactcaacaagatggaaagattcagagactttatggtttggctactgttgctaa

SEQ ID NO: 26892 - DNA, 475 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccaccacctgctccggggtcaagccgtgggcctggcacagcaccggcaacagccgctggaccgtctccagcgcctgcttgccgccatcgtggctggcgatggccaccacctgctatgcaccagttatgttggaccgaatgttgcgtctcttggcttgttacaatatcctcacttgttcagttcgtactcaacaagatggaaagattcagagactttatggtttggctactgttgctaa

SEQ ID NO: 26893 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26894 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26895 - DNA, 466 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacaggattagcagagcgaggtatgtaggcggtgctacagagttcttgaagtggtggcctaactacggctacactagaagaacagtatttggtatctgcgctccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 26896 - DNA, 466 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacaggattagcagagcgaggtatgtaggcggtgctacagagttcttgaagtggtggcctaactacggctacactagaagaacagtatttggtatctgcgctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26897 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacagataaaacgaaaggcccagtcttctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26898 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacagataaaacgaaaggcccagtcttctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26899 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacagataaaacgaaaggcccagtcttctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26900 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacaccattattgctggcgatggccaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26901 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacaccattattgctggcgatggccaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26902 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacaccattattgctggcgatggccaccacccctgatgcaccagttatgttggaccgaatgttgcgtctcttggcttgttacaatatcctcacttgttcagttcgtactcaacaagatggaaaggttcagagactttatggttgggctactgttgctaa

SEQ ID NO: 26903 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacaccattattgctggcgatggccaccacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26904 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaatgcaccagttatgttggaccgaatgttgcgtctcttggcttgttacaatatcctcacttgttcagttcgtactcaacaagatggaaagattcagagactttatggtttggctttgctaa

SEQ ID NO: 26905 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 26906 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26907 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaatgcaccagttatgttgggccgaatgttgcgtctcttggcttgttacaatatcctcacttgttcagttcgtactcaacaagatggaaaggttcagagactttatggtttggctactgttgctaa

SEQ ID NO: 26908 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaacgcaaaaaggccatccgtcaggatggccttctgcttagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26909 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26910 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26911 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26912 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacgtactcaacaagatggaaaggttcagagactttatggtttggctactgttgctaa

SEQ ID NO: 26913 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacggatggcctttttgcgtttctacaaactcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26914 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 26915 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacgcaccagttatgttggaccgaatgttgcgtctcttggcttgttacaatatcctcacttgttcagttcgtactcaacaagatggaaaagttcagagactttatggtttggctactgttgctaa

SEQ ID NO: 26916 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26917 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26918 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26919 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26920 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaggttcagagacttgatggtttggctactgttgctaa

SEQ ID NO: 26921 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacgatgcaccagttatgttggaccgaatgttgcgtctctcggcttgttacaatatcctcacttgttcagttcgtactcaacaagatggaaaggttcagagactttatggtttggctactgttgctaa

SEQ ID NO: 26922 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 26923 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacgatgcaccagtcatgttggaccgaatgttgcgtctcttggcttgttacaatatcctcacttgttcagttcgtactcaacaagatggaaaggttcagagcctgtatggtttggctactgttgctaa

SEQ ID NO: 26924 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcatcagttatgttggaccgaatgttgcgtctcttggcttgttacaatatcctcacttgttctgttcgtactcaacaagatggaaaggttcagagactttatggtttggctactgttgctaa

SEQ ID NO: 26925 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttgtaccggatgttgcgtctcttggcatgttacactatcctcacttgttcagtccgtacccaacaagatggaaaggttcacagactgtatggtttggctactgttgctaa

SEQ ID NO: 26926 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26927 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 26928 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 26929 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttgggttgttacaatatcctcacttgttcagttcgtactcaacaagatggaaaggttcagagactttatggtttggctactgttgctaa

SEQ ID NO: 26930 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26931 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 26932 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgtggcgtctcttggcttgttacaatatcctcacttgttcagttcgtactcaacaagatggaaaggttcagagactttatggtttggctactgttg

SEQ ID NO: 26933 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26934 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 26935 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgtgctgttcgtactgaacaagatggaaagattcagagcctttatggtttggctactgatgctaa

SEQ ID NO: 26936 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 26937 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagagtttatggtttggctactgttgctaa

SEQ ID NO: 26938 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26939 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgtgcagttcgtactcaacaagatggaaagattcagagactttatggtttggctacgttgctaa

SEQ ID NO: 26940 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggcactgttgctaa

SEQ ID NO: 26941 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 26942 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatattgcgtctcttggcttgttacaatatcctcacttgttcagttcgtactcaacaagatggaaaggttcagagactttatggtttggctactgttgctaa

SEQ ID NO: 26943 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttgtctactgttgctaa

SEQ ID NO: 26944 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaaggttcagagactatatggtttggctactgttactaa

SEQ ID NO: 26945 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 26946 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatattgcgtctcttggcttgttacaatatcctcacttgttcagttcgtactcaacaagatggaaagattcagagactttatggtttggctactgttgctaa

SEQ ID NO: 26947 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 26948 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggctttttacaatatcctcacttgttcagttcgtactcaacaagatggaaagattcagagactttatggtttggctactgttgctaa

SEQ ID NO: 26949 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgcaaa

SEQ ID NO: 26950 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 26951 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 26952 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgcta

SEQ ID NO: 26953 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctctcttgttcagttcgtactcaacaagatggaaagattcagagactttatggtttggctactgttgctaa

SEQ ID NO: 26954 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 26955 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctac

SEQ ID NO: 26956 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagtccgtactcaacaagatggaaaggttcagagactttatggtttggccactgttgctaa

SEQ ID NO: 26957 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttagaccgaatgttgcgtctcttggcttgttacaatatcctcacttgttcagttcgtactcaacaagatggaaagattcagagactttatggtttggctactgttgctaa

SEQ ID NO: 26958 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgtgggaccgaatgttgcgtctcttggcttgtgacaatatcctcacttgttcagttcgtactcaggaagagggaaaggttcagaggctgtatggtttggctactggtgctaa

SEQ ID NO: 26959 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgtcggaccgaatgttgcgtctcttggcttgttacaatatcctcacttgttcagttcgtactcaacaagatggaaaagttcagagactttatggtttggctactgttgctaa

SEQ ID NO: 26960 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 26961 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 26962 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 26963 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacgatatcctcacttgttctgttcgtactcaacaagatggaaaggttcagagactttatggtttggctactgttgctaa

SEQ ID NO: 26964 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 26965 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagctatgttggaccgaatgttgcgtctcttggcttgttacaatatcctcacttgttcagttcgtactcaacaagatggaaaggttcagagactttatggtttggctactgttgctaa

SEQ ID NO: 26966 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccaattatgttggaccgaatgttgcgtctcttggcttgttacaatatcctcacttgttcagttcgtactcaacaagatggaaaggttcagagactttatggtttggctactgttgctaa

SEQ ID NO: 26967 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 26968 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26969 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26970 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctaatgcaccagttatgttggaccgaatgttgcgtctcttggcttgttacaatatcctcacttgttcagttcgtactcaacaagatggaaagattcagagactttatggtttggctactgttgctaa

SEQ ID NO: 26971 - DNA, 449 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccgtctccagcggctgttgccgccgccattgctggcgatggccaccccctgctccggggtcaagccgtgggcctggcacagcaccggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26972 - DNA, 449 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccgtctccagcggctgttgccgccgccattgctggcgatggccaccacctgctccggggtcaagccgtgggcctggcacagcaccggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26973 - DNA, 449 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccgtctccagcggctgttgccgccgccattgctggcgatggccaccacctgctccggggtcaagccgtgggcctggcacagcaccggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26974 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26975 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 26976 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 26977 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 26978 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 26979 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 26980 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggttcggctactgttgctaa

SEQ ID NO: 26981 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaataccctcacttgttcagttcgtactcaacaagatggaaaggttcagagactttatggtttggctactgttgctaa

SEQ ID NO: 26982 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagacggaaagattcagagactttatggtttggctactgttgctaa

SEQ ID NO: 26983 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttctgttcgtactcaacaagatggaaaggttcagagactttatggttttgctactgttgctaa

SEQ ID NO: 26984 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtattcaacaagatggaaaggttcagagactttatggtttggctactgttgctaa

SEQ ID NO: 26985 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 26986 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttactaa

SEQ ID NO: 26987 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 26988 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactaaacaagatggaaaagttcagagcctttatggtttggctactgttgctaa

SEQ ID NO: 26989 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttgctactgttgcta

SEQ ID NO: 26990 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 26991 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 26992 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttaaaatatcctcacttgttcagttcgtactcaacaagatggaaaggttcagagactttatggtttggctactgttgctaa

SEQ ID NO: 26993 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtccctttgcttgttacaatatcctcacttgttcagttcgttctcaacaagatggaaaggttccgagactttatggtttggctactgttgctaa

SEQ ID NO: 26994 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttctgttcgtactcaacaagatggaaaggttcagagactttatggtttggctactgtgctaa

SEQ ID NO: 26995 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcctctcttggcttgttacaataacctcacttgttcagttcgtactcaacaagatggaaagggtcagagactttattgtttggctactgttgctaa

SEQ ID NO: 26996 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 26997 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgagtctcgtggcttgttacaatatcctcacttgttcagttcgtactcaacaagatggaaagattcagagactttatggtttggctactgttgataa

SEQ ID NO: 26998 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcatctcttggcttgttacaatatcctcacttgttcagttcgtactcaacaagatggaaagattcagagactttatggtttggctactgttgctaa

SEQ ID NO: 26999 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaaaatcctcacttgttcagttcgtactcaacaagatggaaaggttcagagactttatggtttggctactgttgctaa

SEQ ID NO: 27000 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgtgcagttcgtactcaacaagatggaaaggttcagagactttatggtttgctactgttgctaa

SEQ ID NO: 27001 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttcctaa

SEQ ID NO: 27002 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 27003 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgtcggaccgaatgttgcgtctcttggcttgttacaatatcctcacttgttcagttcgtactcaacaagatggaaaagttcagagactttatggtttggctactgttgctaa

SEQ ID NO: 27004 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttaagttggaccgaatgttgcgtctcttggcttgttacaatatcctcacttgttcagttcgtactcaacaagatggaaaagttcagagactttatggtttggctactgttgctaa

SEQ ID NO: 27005 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27006 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagtcatgttggaccgaatgttgcgtctcttggcttgttacaatatccttacttgttctgttcgtactcaacaagatggaaaggttcagagactttatggtttggctactgttgctaa

SEQ ID NO: 27007 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacccctgatgcaccagttatgttggaccgaatgtttcgtctcttggcttgttacaatatcctcacttgttcagttcgtactcaacaagatggaaagattcagagactttatggtttggctactgttgctaa

SEQ ID NO: 27008 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27009 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27010 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27011 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27012 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccagttatgttggaccgaatgttgcgtctcttggcttgttacaatatcctcacttgttcagttcgtactcaacaagatggaaaggttcagagactttatggtttggctactgttgctaa

SEQ ID NO: 27013 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccagttatgttggaccgaatgttgcgtctcttggcttgttacaatatcctcacttgttcagttcgtactcaacaagatggaaagattcagagactttatggtttggctactgttgctaa

SEQ ID NO: 27014 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccagttatgttggaccgaatgttgcgtctcttggcttgttacaatatcctcacttgttcagttcgtactcaacaagatggaaaagttcagagactttatggtttggctactgttgctaa

SEQ ID NO: 27015 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccaccagttatgttggaccgaatgttgcgtctcttggcttgttacaatatcctcacttgttcagttcgtactcaacaagatggaaaggttcagagactttatggtttggctactgttgctaa

SEQ ID NO: 27016 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccaccagttatgttggaccgaatgttgcgtctcttggcttgttacaatatcctcacttgttcagttcatactcaacaagatggaaaggttcagagactttatggtttggctactgttgctaa

SEQ ID NO: 27017 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccaccagttatgttggaccgaatgttgcgtctcttggcttgttacaatatcctcacttgttcagttcgtactcaacaagatggaaagattcagagactttatggtttggctactgttgctaa

SEQ ID NO: 27018 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccaccagttatgttggaccgaatgttgcgtctcttggcttgttacaatatcctcacttgttctgttcgtactcaacaagatggaaaggttcagagactttatggtttggctactgttgctaa

SEQ ID NO: 27019 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccaacgagtggtggaaggtgtacccctccagcgtgaccgagttcaagttcctgttcgtgtccggccacttcaagggcaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27020 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccaacgagtggtggaaggtgtacccctccagcgtgaccgatttcaagttcctgttcgtgtccggccacttcaagggcaactacctgatgcaccagttatgttggaccgaatgttgcgtctcttggcttgttacaatatcctcacttgttcagttcgtactcaacaagatggaaaggttcagagcctttatggtgtggctactgttgctaa

SEQ ID NO: 27021 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27022 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgttggaccgaatgttgcgtctcttggcttgttacaatatcctcacttgttcagttcgtactcaacaagatggaaaggttcagagactttatggtttggctactgttgctaa

SEQ ID NO: 27023 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgttggaccgaatgttgcgtctcttggcttgttacaatatcctcacttgttcagttcgtactcaacaagatggaaaagttcagagactttatggtttggctactgttgctaa

SEQ ID NO: 27024 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27025 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 27026 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27027 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttactatatcctcacttgttcagttcgtactcaacaagatggaaaggttcagagactttatggtttggctactgttgctaa

SEQ ID NO: 27028 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcatgttacaatatcctcacttgttcagttcgtactcaacaagatggaaaggttcagagactttatggtttggctactgttgctaa

SEQ ID NO: 27029 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27030 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagtcatgttggaccgaatgttgcgtctcttggcttgttacaatatcctcacttgttctgttcgtactcaacaagatggaaagattcagagactttatggtttggctactgttgctaa

SEQ ID NO: 27031 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacagttatgttggaccgaatgttgcgtctcttggcttgttacaatatcctcacttgttcagttcgtactcaacaagatggaaaggttcagagactttatggtttggctactgttgctaa

SEQ ID NO: 27032 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacagttatgttggaccgaatgttgcgtctcttggcttgttacaatatcctcacttgttcagttcgtactcaacaagatggaaaagttcagagactttatggtttggctactgttgctaa

SEQ ID NO: 27033 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27034 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27035 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaaagttcagagactttatggtttggctactgttgctaa

SEQ ID NO: 27036 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaaggttcagagactttatggtttggctactgttgctaa

SEQ ID NO: 27037 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacaccagttatgttggaccgaatgttgcgtctcttgacttgttacaatatcctcacttgttcagttcgtactcaacaagatggaaaagttcagagactttatggtttggctactgttgctaa

SEQ ID NO: 27038 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaagattcagagactttatggtttggctactgttgctaa

SEQ ID NO: 27039 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaaggttcagagactttatggtttggctacgttgctaa

SEQ ID NO: 27040 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttctgttcgtactcaacaagatggaaaggttcagagactttatggtttggctactgttgctaa

SEQ ID NO: 27041 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27042 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 27043 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27044 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaatgcaccagttatgttggaccgaatgtcgcgtctcttggcttgttacaatatcctcacttgttcagttcgtactcaacaagatggaaaagttcagagactttatggtttggctactgttgctaa

SEQ ID NO: 27045 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaatgcaccagttatgttggaccgaatgttgcgtcgcttggcttgttacaatatcctcacttgttcagttcgtactcaacaagatggaaaggttcagagactttatggtttggctactgttgcgaa

SEQ ID NO: 27046 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27047 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27048 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27049 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27050 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27051 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaagttatctcgccctgatccggcgttggcccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27052 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaagttatctcgccctgatccggcgttggcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27053 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaagttatctcgccctgatccggcgttggcccctgatgcaccagttatgtagaaccgaatgttgcgtctctgggcttgttacaatatcctcgcttgttatgttcgtagtctacaagatggaaaagttcagagactttatggtttggctactggtgctag

SEQ ID NO: 27054 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaagttatctcgccctgatccggcgttggcccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27055 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaagttatctcgccctgatccggcgttggcccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 27056 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaagggtttacacacgcgcacatcgttgcgttaagccaacacccggcagcgttagggaccgtcgctgtcaagtatcaggacatgatcgcagcgttgccagaggcgacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27057 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27058 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27059 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27060 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27061 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 27062 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcactttttcagttcgtactcaacaagatggaaaagttcagagactttatggtttggctactgttgctaa

SEQ ID NO: 27063 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27064 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27065 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27066 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaaccagttatgttgggccgaatgttgcgtctcttggcttgttacaatatcctcacttgttcagttcgtactcaacaagatggaaaggttcagagactttatggtttggctactgttgctaa

SEQ ID NO: 27067 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaaccagttatgttggaccgaatgttgcgtctcttggcttgttacaatatcctcacttgttcagttcgtactcaacaagatggaaaggttcagagactttatggtttggctactgttgctaa

SEQ ID NO: 27068 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaaccagttatgttggaccgaatgttgcgtctcttggcttgttacaatatcctcacttgttcagttcgtactcaacaagatggaaagattcagagactttatggtttggctactgttgctaa

SEQ ID NO: 27069 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaaccagttatgttggaccgaatgttgcgtctcttggcttgttacaatatcctcacttgttcagttcgtactcaacaagatggaaaggttcggagactttatggtttggctactgttgctaa

SEQ ID NO: 27070 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaaccagttatgttggaccgaatgttgcgtctcttggcttgttacaatatcctcacttgttcagttcgtactcaacaagatggaaaagttcagagactttatggtttggctactgttgctaa

SEQ ID NO: 27071 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27072 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttcagttcgtactcaacaagatggaaaggttcagagactttatggtttggctactgttgctaa

SEQ ID NO: 27073 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttcagttcgtactcaacaagatggaaagattcagagactttatggtttggctactgttgctaa

SEQ ID NO: 27074 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttcagttcgtactcaacaagatggaaaagttcagagactttatggtttggctactgttgctaa

SEQ ID NO: 27075 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27076 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27077 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27078 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacaacctgacgcaccagttatgttggaccgaatgttgcgtctcttggcttgttacaatatcctcacttgttcagttcgtactcaacaagatggaaaggttcagagactttatggtttcgctactgttgctaa

SEQ ID NO: 27079 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacaaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27080 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaagattcagagactttatggtttggctactgttgctaa

SEQ ID NO: 27081 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27082 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27083 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27084 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcgatgcaccagttatgttggaccgaatgttgcgtcccttggcttgttacaatatcctcacttgttcagttcgtactcaacaagatggaaaggttcagagactttatggtttggctactgttgctaa

SEQ ID NO: 27085 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcctgatgcaccagttatgttggaccgaatgttgcgtctcttggcttgttacaatatcctcacttgttcagttcgtactcaacaagatggaaaagctcagagactttatggtttggctactgttgctaa

SEQ ID NO: 27086 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27087 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27088 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27089 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcccctgatgcaccagttatgttggaccgaatgttgcgtctcttggcttgttacaatatcctcacttgttctgttcgtactcaacaagatggaaaggttcagagcctttatggtttggctactgttgataa

SEQ ID NO: 27090 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 27091 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcccccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27092 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcccccaacacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27093 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcccccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 27094 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcccccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27095 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagccccaacaacgaccaggaacaagcacatcaaccccaacgagtggtggaaggtgtaccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27096 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagccaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27097 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27098 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcacccaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27099 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcacccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27100 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagatgcaccagttatgttggaccgaatgttgcgtctcttggcttgttacaatatcctcacttgttcagttcgtactcaacaagatggaaagattcagagactttatggtttggctactgttgctaa

SEQ ID NO: 27101 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27102 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27103 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagatgcaccagttatgttggaccgaatgttgcgtctcttggcttgttacaatatcctcacttgttcagttcgtactcaacaagatggaaagattcagagcctttatggtttggctactgttgctaa

SEQ ID NO: 27104 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagatgcaccagttatgtaggaccgaatgttgcgtctcttggcttgttacaatatcctcacttgttcagttcgtactcaacaagatggaaagattcagagactttatggtttggctactgttgctaa

SEQ ID NO: 27105 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagatcccagccactcagccgcgggtttcgggagtttaatgagctaagcacatacgtcagaaaccattattgcgcgttcaaaagtcactgatgcaccagttatgttggaccgaatgttgcgtctcttggcttgttacaatatcctcacttgttcagttcgtactcaacaagatggaaaggttcagagactttatggtttggccactgttgctaa

SEQ ID NO: 27106 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagatcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27107 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagatcccaacaactaaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27108 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagaccgaatgttgtgtctcttggcttgttacaatatcctcacttgttcagttcgtactcaacaagatggaaagattcagagactttatggtttggctactgttgctaa

SEQ ID NO: 27109 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagaccgaatgttgcgtctcttggcttgttacaatatcctcacttgttcagttcgtactcaacaagatggaaaagttcagagactttatggtttggctactgttgctaa

SEQ ID NO: 27110 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagaccgaatgttgcgtctcttggcttgttacaatatcctcacttgttcagttcgtactcaacaagatggaaagattcagagcctttatggtttggctactgttgctaa

SEQ ID NO: 27111 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagaccgaatgttgcgtctcttggcttgttacaatatcctcacttgttcagttcgtactcaacaagatggaaaggttcagagactttatggtttggctactgttgctaa

SEQ ID NO: 27112 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagaccgaatgttgcgtctcttggcttgttacaatatcctcacttgttcagttcgtactcaacaagatggaaagattcagagactttatggtttggctactgttgctaa

SEQ ID NO: 27113 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27114 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27115 - DNA, 455 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcacctcccaacaactagcaaatatttcttgtcaaaaatgctccactgacgttccataaattcccctcggtatccaattagagtctcatattcactctcaatccaaataatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27116 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaaggttcagagactttatggtttggctactgttgctaa

SEQ ID NO: 27117 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaagattcagagactttatggtttggctactgttgctaa

SEQ ID NO: 27118 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaaggttcagagactttatggtttggctactgttgctag

SEQ ID NO: 27119 - DNA, 341 bp, Artificial
  MsCOMT deletion introduced by TALEN pair MsCOMT_T03.1
  misc_feature (341): n is a or c or t or g
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaaggttcagagactttatggtttggctactgttgctan

SEQ ID NO: 27120 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaccagttatgttggaccgaatgttgcgtcgcttggcttgttacaatatcctcccttgttgagttcgtagtcaacaagatggaaaggttcagagactttaggatttgggtactgttgttaa

SEQ ID NO: 27121 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaacttgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27122 - DNA, 270 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaacaagatggaaaggttcagagactttatggtttggctactgttgctaa

SEQ ID NO: 27123 - DNA, 270 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaacaagatggaaaagttcagagactttatggtttggctactgttgctaa

SEQ ID NO: 27124 - DNA, 359 bp, Artificial
  MsCOMT deletion introduced by TALEN pair MsCOMT_T03.1
  misc_feature (359): n is a or c or t or g
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctagctcccaacatctgatgcaccagttatgttggaccgaatgttgcgtctcttggcttgttacaatatcctcacttgttcagttcgtactcaacaagatggaaagattcagagactttatggtttggctactgttgctan

SEQ ID NO: 27125 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctaagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27126 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcgcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27127 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcccagctcccaacacctcaccagttatgttggaccgaatgttgcgtctcttggcttgttacaatatcctcacttgttcagttcgtactcaacaagatggaaaggttcagagactttatggtttggctactgttgctaa

SEQ ID NO: 27128 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcccagaccgaatgttgcgtctcttggcttgttacaatatcctcacttgttctgttcgtactcaacaagatggaaaggttcagagactttatggtttggctactgttgctaa

SEQ ID NO: 27129 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgctcctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27130 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgctcctcagctcccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27131 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgctactcagctcccaacaacctgatgcaccagttatgttggaccgaatgttgcgtctcttggcttgttacaatatcctcacttgttcagttcgtactcaacaagatggaaaggttcagagactttatggtttggctactgtagctaa

SEQ ID NO: 27132 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgctactcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27133 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcgtctcagctccgaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27134 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcgtctcagctaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27135 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcctctcagctcccaacaatttatgttggaccgaatgttgcgtctcttggcttgttacaatatcctcacttgttcagttcgtactcaacaagatggaaagattcagagactttatggtttggctactgttgctaa

SEQ ID NO: 27136 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcctctcagctaccaacaacttatgttggaccgaatgttgcgtctcttggcttgttacaatatcctcacttgttcagttcgtactcaacaagatggaaaggttcagagactttatggtttggctactgttgctaa

SEQ ID NO: 27137 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcctctcagctaccaacaactaaacgcaaaaaggccatccgtcaggatggccttctgcttagctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27138 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcatctcagctcccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27139 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcatctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27140 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27141 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27142 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27143 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattaccctgatgcaccagttatgttggaccgaatgttgcgtctcttggcttgttacaatatcctcacttgttcagtacgtactcaacaagatggaaagattcagagactttatggtttggctactgttgctaa

SEQ ID NO: 27144 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27145 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttcagttcgtactcaacaagatggaaaagttcagagactttatggtttggatactgttgctaa

SEQ ID NO: 27146 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27147 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27148 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27149 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatcgcttctcagctcccaacaactgatgcaccagttatgatggaccgaatgttgcgtctcttggcttgttacaatatcctcacttgttcagttcgtactcaacaagatggaaaggttcagagactttatggtttggctactgttgctaa

SEQ ID NO: 27150 - DNA, 331 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatcgcttctcagctaccaatgttgcgtctcttggcttgttacaatatcctcacttgttcagttcgtactcaacaagatggaaaagttcagagactttatggtttggctacctgttgctaa

SEQ ID NO: 27151 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatagcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27152 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaagtgcttctcagctcccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27153 - DNA, 300 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaagtgcttctcagctcatcctcacttgttcagttcgtactcaacaagatggaaagattcagagactttatgggttggctactggtgcgaa

SEQ ID NO: 27154 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaagtgcttctcagctaccaacaacctgatgcaccagttatgttggaccgaatgttgcgactcttggcttgttacaatatcctcacttgttcagttcgtactcaacaagatggaaagattcagagactttatggtttggctactgttgctaa

SEQ ID NO: 27155 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaactgcttctcagctcccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27156 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27157 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27158 - DNA, 331 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaaccagttatgttggaccgaatgttgcgtctcttggcttgttacaatatcctcacttgttcagttcgtactcaacaagatggaaaggttcagagactttatggtttggctactgttgctaa

SEQ ID NO: 27159 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattcaaattgcttctcagcttccaacaactaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27160 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattcaaattgcttctcagctcccaacaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 27161 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattcaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27162 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattaaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27163 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctatcgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 27164 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctatcgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27165 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctatcgaaattgcttctcagctcccaacaactagcaccagttatgttggaccgaatgttgcgtctcttggcttgttacaatatcctcacttgttcagttcgtactcaacaagatggaaagattcagagactttatggtttggctactgttgctaa

SEQ ID NO: 27166 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctatcgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27167 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctatcgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27168 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctatcgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27169 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctactgaaattgcttctcagctcccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27170 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctactgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27171 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctactgaaattgcttctcagctcccaacaactgatgcaccagtcatgttggaccgaatgttgcgtctcttggcttgttacaatatcctcacttgttcagttcgtactcaacaagatggaaaggttcagagactttatggtttggctactgttctaa

SEQ ID NO: 27172 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctactgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27173 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctactgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27174 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctaatgaaattgcttctcagctcccaacaactacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27175 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaccgattgaaattgcttctcagctaccaacaacctgatgcaccagttatgttggaccgaatgttgcgtctcttggcttgtgacaatatcctcacttgttcagttcgtactcaacaagatggaaaggttcagagactttatggtttggctactgttgctaa

SEQ ID NO: 27176 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacccattgaaattgcttctcagctcccaacaactctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 27177 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacccattgaaattgcttctcagctcccaacaaccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27178 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaccagtcatgttggaccgaatgttgcgtctcttggcttgttacaatatcctcacttgttctgttcgtactcaacaagatggaaaggttcagagactttatggtttggctactgttgctaa

SEQ ID NO: 27179 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaccagtcatgttggaccgaatgttgcgtctcttggcttgttacaatatcctcacttgttcagttcgtactcaacaagatggaaaagttcagagactttatggtttggctactgttgctaa

SEQ ID NO: 27180 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaccagtcatgttggaccgaatgttgcgtctcttggcttgttacaatatcctcacttgttcagttcgtactcaacaagatggaaagattcagagactttatggtttggctactgttgctaa

SEQ ID NO: 27181 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaccagtcatgttggaccgaatgttgcgtctcttggcttgttacaatatcctcacttgttctgttcgtactcaacaagatggaaagattcagagactttatggtttggctactgttgctaa

SEQ ID NO: 27182 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaccagtcatgttggaccgaatgttgcgtctcttggcttgttacaatatcctcacttgttcagttcgtactcaacaagatggaaaggttcagagactttatggtttggctactgttgctaa

SEQ ID NO: 27183 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaccagtcatgttggaccgaatgttgcgtctcttggcttgttacaatatcctcacttgttctgttcgtactcaacaagatggaaaggttcagagactttatggtttggctactgtggctaa

SEQ ID NO: 27184 - DNA, 320 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaccagtcatgttggaccgaatgttgcgtctcttggcttgttacaatatcctcacttgttctgttcgtactcaacaagatggaaaggttcagagactttatggtttggtactgttgctaa

SEQ ID NO: 27185 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacatattgaaattgcttctcagctcccaacaactgagcctttcgttttatctgttgtttgttggtgaacgctctcctgagtaggacaaatccctgatgcaccacttatgttggaccgaatgttgcgtctcttggcttgttccaatatcctcacttcttcagttcttactcaacaagatggaaaggttcagagactttatggtttggctactgttgctaa

SEQ ID NO: 27186 - DNA, 300 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttaacctattgaaattgcttctcagctcatcctcacttgttcagttcgtactcaacaagatggaaagattcacagtctttatggtttggctactgttgctaa

SEQ ID NO: 27187 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttaacctattgaaattgcttctcagctcacaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27188 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaattgcacctattgaaattgcttctcatctaccatgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 27189 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaattgcacctattgaaattccttctcagctcccaacaatgctgcaccagttatgttggaccgaatgttgcgtctcttggcttgttacaatatcctcacttgttcagttcgcactcaacaagatggaaagattcagagactttatggtttggctactgttcctaa

SEQ ID NO: 27190 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaattccacctagtgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 27191 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaattacacctattgaaattgcttctcagctcccaacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27192 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaattacacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27193 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatctcacctgttcaaattgcttctcagcttccaacctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 27194 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatctcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27195 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatctcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27196 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatatcacctgttcaaattgcttctcagcttccaacaactctgatgcaccagtcatgttggaccgaatgttgcgtctctttgcttgttacaatatcctcacttgttctgttcgtactcaacaagatggaaaggttcagagactttatggtttggctactgttgctaa

SEQ ID NO: 27197 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaacttcacctattgaaattgcttctcagctcccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27198 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctaaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27199 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctaaaatttcacctattgaaattgcttctcagctcccaacaactaccagttatgttggaccgaatgttgcgtcgcttggcttgttacaatatcctcacttgttcagttcgtactcaacaagatggaaagattcagagactttatggtttggctactgttgctaa

SEQ ID NO: 27200 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctaaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27201 - DNA, 447 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctaaaatttcacctattgaaattgcatctcagctcccaacaactacatacgtcagaaaccattattgcgcgttcaaaagtcgcctaaggtcactatcagctagcaaatatttcttgtcaaaaatgctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27202 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcgcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27203 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcgcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27204 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27205 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27206 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaacttatgttggaccgaatgttgcgtctcttggcttgttacaatatcctcacttgttcagttcgtactcaacaagatggaaagattcagagactttatggtttggctactgttgctaa

SEQ ID NO: 27207 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 27208 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaacaacttgcgtctcttggcttgttacaatatcctcacttgttcagttcgtactcaacaagatggaaagattcagagactttatggtttggctactgttgctaa

SEQ ID NO: 27209 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27210 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaacaactgatgcaccagttatgttggaccgaatgttgcgtctcttggcttgttacaatatcctcacttgtgcagttcgtactcaacaagatggaaaggttcagagactttatggtttggcactgttgctaa

SEQ ID NO: 27211 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaacaactaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27212 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27213 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27214 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27215 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 27216 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27217 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcccaaatttcacctattgaaattgcttctcagctaccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 27218 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcaccagttatgttggaccgaatgttgcgtctcttgtcttgttacaatatcctcacttgttcagttcgtactcaacaagatggaaaagttcagagactttatggtttggctactgttgctaa

SEQ ID NO: 27219 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcaccagttatgttggaccgaatgttgcgtctcttggcttgttacaatatcctcacttgttctgttcgtactcaacaagatggaaagattcagagactttatggtttggctactgttgctaa

SEQ ID NO: 27220 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcaccagttatgttggaccgaatgttgcgtctcttggcttgttacaatatcctcacttgttctgttcgtactcaacaagatggaaaggttcagagactttatggtttggctactgttgctaa

SEQ ID NO: 27221 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 27222 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaagattcagagactttatggtttggctactgttgctaa

SEQ ID NO: 27223 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaaagttcagagactttatggtttggctactgttgctaa

SEQ ID NO: 27224 - DNA, 311 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaaggttcagagactttatggtttggctactttgctaa

SEQ ID NO: 27225 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcacaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 27226 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcacaaatttcacctattgaaattgcttctcagctcccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27227 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgcacaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27228 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27229 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27230 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27231 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgatcaaatttcacctattgaaattgcttctcagctcccaacaacttgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 27232 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgatcaaatttcacctattgaaattgcttctcagctcccaacaacttccctgatgcaccagttatgttggaccgaatgttgcgtctcttggcttgttacaatatcctcgcttgttcagttcgtactcaacaagatggacagtttcagagactttatggtttggctactgttgctaa

SEQ ID NO: 27233 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgatcaaatttcacctattgaaattgcttctcagctcccaacaactacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27234 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgatcaaatttcacctattgaaattgcttctcagctcccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27235 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgatcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27236 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgatcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27237 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgatcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27238 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtcctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27239 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtcctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27240 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtcctcaaatttcacctattgaaattgcttctcagctaccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27241 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctgttcaaattgcttctcagcttccaacagctgatgcaccagttatgttggaccgaatgttgcgtctcttggcttgttacaatatcctcgcttgttcagttcgtactcaacaagatggaaagattcagagactttatggtttggctactgttgctaa

SEQ ID NO: 27242 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagcttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27243 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctcccaacaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 27244 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctcccaacaactaaccctgttggaccgaatgttgcgtctcttggcttgttacaatatcctcacttgttcagttcgtactcaacaagatggaaagattcagagactttatggtttggctactgttgctaa

SEQ ID NO: 27245 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctcccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27246 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27247 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27248 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctcccaacaaatgcaccagttatgttggaccgaatcttgcgtctcttggcttgttacaatatcctcacttgttcagttcgtactcaacaagatggaaaggttcagagactttatggtttggctactgttgctaa

SEQ ID NO: 27249 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27250 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27251 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtactcaaatttcacctattgaaattgcttctcagctaccaacaaccacctgctccggggtcaagccgtgggcctggcacagcaccggcaacagccgctggaccgtctccagcgcctctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27252 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggggctcaaatttcacctattgaaattgcttctcatctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27253 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggcgctcaaatttcacctattgaaattgcttctcagctcccaacaactgatgcaccagttatgttggaccgaatgttgcgtctcttggcttgttacaatatcctcacttgttcagttcatactcaacaagatggaaagattcagagactttatggtttggctactgttgctaa

SEQ ID NO: 27254 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggcgctcaaatttcacctattgaaattgcttctcagctcccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 27255 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggcgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27256 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggcgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27257 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggagctcaaatttcacctattgaaattgcttctcagctcccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27258 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggagctcaaatttcacctattgaaattgcttctcagctcccaacaacctgatgcaccagttatgttggaccgaaaggtgcgtctcttggctagttacaatatcctcaattgttcagttcgtactcagcaagatggaaagattcagagactttatggtttggctactgttgctaa

SEQ ID NO: 27259 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgctgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27260 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgatgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27261 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgatgctcaaatttcacctattgaaattgcttctcagctcccaacaactaacagcaacaaaccaacccttagttgcacacccttgtgtttttctttgtgtgttgtttgttttattttcttagtccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27262 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgatgctcaaatttcacctattgaaattgcttctcagctaccaacaactgatgcaccagttatgttggaccgaatgttgcgtctcttggcttgttacaatatcctcacttgttcagttcgtactcaaccagatggaaaggttcagagactttatcgtttggctactgttgctaa

SEQ ID NO: 27263 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27264 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27265 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27266 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgatgcaccagttatgttggaccgaatgttgcgtctcttggcttgttacaatatcctcacttgttcaggtcgtactcaacaagatggaaagattcagagactttatggtttggctactgtggctaa

SEQ ID NO: 27267 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgatgcaccagttatgttggaccgaatgttgcgtctcttggcttgttacaataacctcacttgttcagttcgtactcaacaagatggaaagattcagagactttatggtttggctactgttgctaa

SEQ ID NO: 27268 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctcgtactcaaatttcacctattgaaatttctgctcagctaccaacaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27269 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctagtgctcaaatttcacctattggaattgcttctcagatcccaacaacttgatgcgccatttatgttggaccgaatgttgcgtctcttggcttgttacaatatcctcacttgttctgttcgtactcaacaagatggaaaggttcagagactttatggtttggctactgttgctaa

SEQ ID NO: 27270 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctagtgctcaaatttcacctattgaaattgcttctcagcttccaatgatgcaccagttatgttggaccgaatgtggcgtctcttggcttgttacaatatcctcagttgttcagttcctactcaacaagatggaaaggttcagagactttatggtttggctactgttgcgaa

SEQ ID NO: 27271 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctagtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27272 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccgggtgctcaaatttcacctattgaaattgcttctcagctcccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 27273 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccgaatgttgcgtctcttggcttgttacaatatcctcacttgttcagttcgtactcaacaagatggaaaggttcagagactttatggtttggctactgttgctaa

SEQ ID NO: 27274 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccgaatgttgcgtctcttggcttgttacaatatcctcacttgttcagttcgtactcaacaagatggaaagattcagagactttatggtttggctactgttgctaa

SEQ ID NO: 27275 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccgaatgttgcgtctcttggcttgttacaatatcctcacttgttcagttcgtactcaacaagatggaaagattcagagactttatggtttggctactgttgataa

SEQ ID NO: 27276 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccgaatgttgcgtctcttggcttgttacaatatcctcacttgttcagttcgtactcaacaagatggaaaagttcagagactttatggtttggctactgttgctaa

SEQ ID NO: 27277 - DNA, 288 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccgaatgttgcgtctcttggcttgttacaatatcctcacttgttcagttcgtactcaacaagatggaaaagttcagagactttatggtttgctactgttgctaa

SEQ ID NO: 27278 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacccggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 27279 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacccggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27280 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacccggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27281 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacccggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27282 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacccggtgctcaaatttcacctattgaaattgcttctcagctaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27283 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacccggtgctcaaatttcacctattgaaattgcttctcagctaccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27284 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccaggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27285 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaactggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 27286 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaactggtgctcaaatttcacctattgaaattgcttctcagctaccaacaactaacggataaaacgaaaggcccagtcttctgatgcaccagttatgttggaccgaatgttgcgtctcttagcttgttacaatatcctcacttgttcagttcgtactcaacaagatggaaaggttcagagcctttatggtttggctactgttgctaa

SEQ ID NO: 27287 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaactggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27288 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaactggtgctcaaatttcacctattgaaaatgcttctcagctaccaacatctgatgcaccagttatgttggaccgaatgttgcgtctcttggcttgttacaatttcctcacttgttcagttcgtactcaacaagatgtaaagattcagagactttattgtttggctactgatgctaa

SEQ ID NO: 27289 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgcctgatgcaccagttatgttggaccgaatgttgcgtctcttggcttgttacgatatcctcacttgttcagttcgtactcaacaagatggaaaggttcagagactttatggtttggctactgttgctaa

SEQ ID NO: 27290 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27291 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgcacctagtgctcaaatttcacctattgaaattgcttctcagctaccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27292 - DNA, 410 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgcaccgtctccagcgcctgcttgccaccaatattgctggcgatggccaccacctgctccggggtcaagccgtgggcctggcacagcaccggcaacagccgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27293 - DNA, 410 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgcaccgtctccagcgcctgcttgccaccaatattgctggcgatagccaccacctgctccggggtcaagccgtgggcctggcacagcaccggcaacagccgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27294 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgagttatgttggaccgaatgttgcgtctcttggcttgttacaatatcctcacttgttcagttcgtactcaacaagatggaaagattcagagactttatggtttggctactgttgctaa

SEQ ID NO: 27295 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgagttatgttggaccgaatgttgcgtctcttggcttgttacaatatcctcacttgttcagttcgtactcaacaagatggaaaggttcagagactttatggtttggctactgttgctaa

SEQ ID NO: 27296 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgaacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27297 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctagacctggtgctcaaatttcatctattgaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27298 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctagacctggtgctcaaatttcacctattgaaattgcttctcagctctaaaccatttatgttgaaccgaatatttcgtctcttaacttattacaatatcctcacttcttcacttcctactcaacaaaataaaaaatttcagagactttatggtttatctactgttgctaa

SEQ ID NO: 27299 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctagacctggtgctcaaatttcacctattgaaattgcttctcagctcccaacaacctgatgcaccagttatgttggaccgaatgttgcgtctcttgtcttgttacaatatcctcacttgttcagttcgtactcaacaagatggaaagattcagagactttatggtttggctactgttgctaa

SEQ ID NO: 27300 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctagacctggtgctcaaatttcacctattgaaattgcttctcagctaccaacaaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27301 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctagacctggtactcaaatttcacctattgaaattgcttctcacctcccaactgatgcaccagttatgttggaccgaatgttgcatctcttggcttgttacaatatcctcacatgttcagttcgtactcaacaagatggaaagattcagagactttatggtttggctactgttgctaa

SEQ ID NO: 27302 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27303 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctattgaaattgcttctcagctcccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27304 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27305 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27306 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctattgaaattgcttctcagctaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27307 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctattgaaattgcttctcagctaccaacaacatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27308 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagcagtacctgttgctcaaatttcacctattgaaattgcttctcagctaccaacaactgatgcaccagttatgttggaccgaatgttgcgtctcttggcttgtgacaatatcctcacttgttcagttcgtactcaacaagagggaaaggttcagagactttatggtttggctactgttgttaa

SEQ ID NO: 27309 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagcaggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27310 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagatggacctggtgctcaaatttcacctattgaaattgcttctcagctcccaacacagatgcaccagttatgttggaccgaaagttgcgtctcttggcttgttacaatatcctcacttgttcagttcgtactcaacaagatggaaaagttcagagactttatggtttggctactgttgctaa

SEQ ID NO: 27311 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagatggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 27312 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagatggacctggtgctcaaatttcacctattgaaattgcttctcagctcccaacaaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27313 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagatggacctggtgctcaaatttcacctattgaaattgcttctcagctcccaacaaaatgcaccagttatgttggaccgaatgttgcgtctcttgccttgttacaatatcctctcttgttcagttcgtactcaacaagatggaaagattcagagactttatggtttggctactgttgctaa

SEQ ID NO: 27314 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagatggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27315 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagatggacctggtgctcaaatttcacctattgaaattgcttctcagctaccaacaacatgcaccagttatgttgaaccgaatattgcgtctcttggcttgttacaatatcctcacttgttcagttcgtactcaacaagatggaaaggttcagagactttatggtttggctactgttgctaa

SEQ ID NO: 27316 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaaactggacctggtgctcaaatttcacctattgaaattgcttctcagctaccaacattcaccagttatgtttgaccgaatatttcgtctctttgcttgttacaatatcctcactttttcagttcgtactcaacaagatggaaagtttcagagactttatggtttagctactgttcctaa

SEQ ID NO: 27317 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccaaagctggacctggtgctcaaatttcacctattgaaattgcttctcagctcccaacaatgttggaccgaatgttgcgtctcttggcttgttacaatatcctcacttgttcagttcgtactcaacaagatggaaaggttcagagactttatggtttggatactgttgctaa

SEQ ID NO: 27318 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27319 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27320 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27321 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27322 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgcaaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaagttcagagactttatggtttggctacgttgctaa

SEQ ID NO: 27323 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgataaagctggacctggtgctcaaatttcacctgttcaaattgcttctcagcttgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27324 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgataaagctggacctggtgctcaaatttcacctattgaaattgcttctcagctcccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27325 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgataaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27326 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgataaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27327 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgataaagctggacctggtgcccaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27328 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattcctaaagctggacctggtgctcaaatttcacctattgaaattgcttctcagctcccaacactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27329 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattactaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27330 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattactaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27331 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattactaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 27332 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattactaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27333 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaaggttcacagactttatggtttggctactgttgctaa

SEQ ID NO: 27334 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27335 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatcgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27336 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcatagctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27337 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27338 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactgctaaagctggacctggtgctcaaatttcacctattgaaattgcttctcagctaccaacaacttgcgtctcttggcttgttacaatatcctcacttgttcagttcgtactcaacaagatggaaaggttcagagactttatggtttggctactgttgctaa

SEQ ID NO: 27339 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactgctaaagctggacctggtgctcaaattacacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27340 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcactgctaaagctgaacctggtgctcaaatttcacctattgaaattgcttctcagctaccaacaccagttatgttggaccgaatgttgcgtctcttggcttgttacaatatcctcacttgttcagttcgtactcaacaagatggaaaagttcagagactttatggtttggctactgttgctaa

SEQ ID NO: 27341 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaatgctaaagctggacctggtgctcaaatttcacctattgaaattgcttctcagctcccaacacatgcaccagttatgttggaccgaatgttgcgtctcttggcttgttacaatatcctcacttgttcagttcgtactcaacaagatggaaagattcagagactttatggtttggctactgttgctaa

SEQ ID NO: 27342 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcaatgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27343 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataattgttaaagctgaacctggtgctcaaatttctcctattgaaattgcatctcagctcccaacaactaaccacgagggcggcaccagccgctggagactgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 27344 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataattgctaaagctggacctggtgctcaaatttcacctattgaaattgcttctcagctcccaacctgatgcaccagttatgttggaccgaatgttgcgtctcttggctggttacaatatcctcacttgttcagttcgtactcaacaagatggaaagattcagagactttatggtttggctactgttgctaa

SEQ ID NO: 27345 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27346 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaataattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27347 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27348 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttaaaaatcattgctaaagctggacctggtgctcaaatttcacctattgaaattgcttctcagctaccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27349 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctcagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 27350 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctcagaaatcattgctaaagctggacctggtgctcaaatttcacctattgaaattgcttctcagctcccaacacatgcaccagttatgttggaccgaatgttgcgtctcttggcttgttacaatatcctcacttgttcagttcgtactcaacaagatggaaagattcagagactttatggtttggctactgttgctaa

SEQ ID NO: 27351 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctcagaaatcattgctaaagctggacctggtgctcaaatttcacctattgaaattgcttctcagaccgaatgttgcgtctcttggcttgttacaatatcctcacttgttcagttcgtactcaacaagatggaaagattcagagactttatggtttggctactgttgctaa

SEQ ID NO: 27352 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctagaaatcattgctaaagctggacctggtgctcaaatttcacctattgaaattgcttctcagctcccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27353 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctctagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27354 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcgtagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27355 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcgtagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 27356 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcctagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27357 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcctagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 27358 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcctagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27359 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctattagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 27360 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacaagatggtaagattcagagactttatggtttggctactgttgctaa

SEQ ID NO: 27361 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacaagatggaaggattcagagactttatggtttggctactgttgctaa

SEQ ID NO: 27362 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacaagatggaaaggttcagagactttatggtttggctactgttgctaa

SEQ ID NO: 27363 - DNA, 206 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacaagatggaaagattcagagactttatggtttggctatgttgctaa

SEQ ID NO: 27364 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacaagatggaaagattcagagactttatggtttggctactgttgctaa

SEQ ID NO: 27365 - DNA, 206 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacaagatggaaagattcagagactttatggtttggcactgttgctaa

SEQ ID NO: 27366 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctacaagatggaaaagttcagagactttatggtttggctactgttgctaa

SEQ ID NO: 27367 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctaaaagatggaaagattcagagactttatggtttggctactgttgctaa

SEQ ID NO: 27368 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcgcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27369 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcccttagaaatcattgctaaagctggacctggtgctcaaatttcacctgttcaaattgcttctcagcttccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27370 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcccttagaaatcattgctaaagctggacctggtgctcaaatttcacctattgaaattgcttctcagctcccaacaacgcagtggaggcagtgcatgcatggcgcaatgcactgagcggggtgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27371 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcccttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27372 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatcaacaagatggaaagattcagagactttatggtttggctactgttgctaa

SEQ ID NO: 27373 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatatcttagaaatcattgctaaagctggccctgcttctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27374 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatatcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27375 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatatcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27376 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatatcttagaaatcattgctaaagctggacatggtactcaaatttcacctattgaaatagcttctcagctaccaacaatgatgcaccagttatgttggaccgaatgttgcgtctcttgacttgttacaatatcctcacttgttcagttcgtactcaacaagatggaaaggttcagagactttatggtttggctactgttgctaa

SEQ ID NO: 27377 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgacctcttagaaatcattgctaaagctggacctggtgctcaaatttcacctattgaaattgcttctcagctcccaacaactaccggcaacagccgctggaccgtctccagcgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27378 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgaactcttagaaatcattgctaaagctggacctggtgctcaaatttcacctattgaaattgcttctcagctaccaacaactgatgcaccagttatgttggaccgaatgttgcgtctcttgcttgttacaatatcctcacttgttcagttcgtactcaacaagatggaaagattcagagactttatggtttggctactgttgctaa

SEQ ID NO: 27379 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttcatctcttagaaatcattgctaaagctggacctggtgctcaaatttcacctattgaaattgcttctcagctcccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27380 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27381 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27382 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttaatctacaagatggaaagattcagagactttatggtttggctactgttgctaa

SEQ ID NO: 27383 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactcgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27384 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactcgatctcttagaaatcattgctaaagctggacctggtgctcaaatttcacctattgaaattgcttctcagctcccaactgatgcaccagttatgttggaccgaatgttgcgtctcttgacttgttacaatatcctcacttgttcatttcgtactcaacaagatgtaaatattcagagactttatggtttggctactgttgctaa

SEQ ID NO: 27385 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactcgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaagattcagagactttatggtttggctactgttgctaa

SEQ ID NO: 27386 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactcgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27387 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactcgatctcttagaaatcattgctaaagctggacctggtgctcaaatttcacctattgaaattgcttctcagctcccaacaacatgttggaccgaatgttgcgtctcttggcttgttacaatatcctcacttgttcagttcgtactcaacaagatggaaaggttcagagactttatggtttggctactgttgctaa

SEQ ID NO: 27388 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactcgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27389 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaactcgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27390 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacctgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27391 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacctgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 27392 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacatgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27393 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacatgatctcttagaaatcattgctaaagctggacctggtgctcaaatatcacctattgaaattgcttctcagctcccaacaacttgatgcaccgattatgtttgaccgaaaggtgcgtctcttggcttgttacaatatcctcacttgatcagttcgtactcaacaagacggaaaaattaacagactttatggtttagctacttttgctaa

SEQ ID NO: 27394 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttcaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27395 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27396 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttaaacttgatctcttagaaatcattgctaaagctggacctggtgctcaaatttcacctcttgaaattgcttctcagctcccaacaactgatgcaccagttatgttggaccgaatgttgcgtcacttggcttgttacaatatccacacttgttcagttcgtactcaacaagacggaaagattcagagactttatagtgtggtgattgttgctaa

SEQ ID NO: 27397 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttaaacttgatctcttagaaatcattgctaaagctggacctggtgctcaaatttcacctattgaaattgcttctcagctcccaacaactaaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27398 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttaaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27399 - DNA, 269 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctgcaccagttatgttggaccgaatgttgcgtctcttggcttgttacaatatcctcacttgttcagttcgtactcaacaagatggaaaggttcagagactttatggtttggctactgttgctaa

SEQ ID NO: 27400 - DNA, 269 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctgcaccagttatgttggaccgaatgttgcgtctcttggcttgttacaatatcctcacttgttcagttcgtactcaacaagatggaaagattcagagactttatggtttggctactgttgctaa

SEQ ID NO: 27401 - DNA, 269 bp, Artificial
  MsCOMT deletion introduced by TALEN pair MsCOMT_T03.1
  misc_feature (269): n is a or c or t or g
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctgcaccagttatgttggaccgaatgttgcgtctcttggcttgttacaatatcctcacttgttcagttcgtactcaacaagatggaaagattcagagactttatggtttggctactgttgctan

SEQ ID NO: 27402 - DNA, 269 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctgcaccagttatgttggaccgaatgttgcgtctcttggcttgttacaatatcctcacttgttcagttcgtactcaacaagatggaaaagttcagagactttatggtttggctactgttgctaa

SEQ ID NO: 27403 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctgttgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 27404 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctgttcaaattgcttctcagcttccaacaatatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27405 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctgttcaaattgcttctcagcttccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27406 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctgttcaaattgcttctcagcttccaacaactaatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27407 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctcccaatgcaccagttatgttggtccgaatgttgcgtctcttggcttgttacaatatcctcacttgttctgttcgtactcaacaagatggaaaggttcagagactttatggtttggctactgttgctaa

SEQ ID NO: 27408 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27409 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 27410 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27411 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27412 - DNA, 464 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctcccaacaactaaccgactggaaagcgggcagtgagcgcaacgcaattaatacgcgtaccgctagccaggaagagtttgtagaaacgcaaaaaggccatccgtcaggatggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27413 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctcccaacaactaaccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27414 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27415 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27416 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27417 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27418 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctcgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27419 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctatgttggaccgaatgttgcgtctcttggcttgttacaatatcctcacttgttcagttcgtactcaacaagatggaaaggttcagagactttatggtttggctactgttgctaa

SEQ ID NO: 27420 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctagaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27421 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctagaacttgatctcttagaaatcattgctaaagctggacctggtgctcaaatttcacctattgaaattgcttctcagctcccaacaacgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27422 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctctagaacttgatctacaagatggaaagattcagagactttatggtttggctactgttgctaa

SEQ ID NO: 27423 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcgtgaacttgatctcttagaaatcattgctaaagctggacctggtgctcaaatttcacctattgaaattgcttctcagctcccaacaactgatgcaccagttatgttggaccgaatgttgcgtctcttggattgttacaatatcctcacttgtgcagtgcgtactcaacaagatggaaagagtcagagactttatggtttggctactgttgctaa

SEQ ID NO: 27424 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcgtgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27425 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcctgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27426 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcctgaacttgatctcttagaaatcattgctaaagctggacctggtgctcaaatttcacctattgaaattgcttctcagctcccaacaacagataccaaatactgttcttctagtgtagccgtagttaggccaccacttcaagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27427 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcctgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27428 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcctgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27429 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcctgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27430 - DNA, 460 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcatgaacttgatctcttagaaatcattgctaaagctggacctggtgctcaaatttcagctattgaaattgcttctcagctcccaacaactaaccaatgaaaaggggcagccgccacccataaaatatataggacccctataggactcatgtgcatattaaccgtttgccacccatgctttcatatccactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27431 - DNA, 460 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcatgaacttgatctcttagaaatcattgctaaagctggacctggtgctcaaatttcacctattgaaattgcttctcagctcccaacaactaaccaatgaaaaggggcagccgccacccatgaaatatataggacccctataggactcatgtgcatattaaccgtttgccacccatgctttcatatccactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27432 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcatgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27433 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcatgaacttgagctcttagaaatcattgctaaagctggacctggtgctcaaatttcacctattgaaattgctactcagctcccaagatgcaccagttatcttggaccagatgtagcatctcatggcttattacaatgtcctcacttgttcagttcgtactcaacaagatggaaaggttcagagactgtatggtttggctactgttgctaa

SEQ ID NO: 27434 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctattgaacttgatctcttagaaatcattgctaaagctggacctggtgctcaaatttcacctattgaaattgcttcttagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27435 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctattgaacttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctctcttgttcagttcgtactcaacaagatggaaaggttcagagactttatggtttggctactgttgctaa

SEQ ID NO: 27436 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagcccttgaacttgatctcttataaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27437 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagcccttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27438 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagcccttgaacttgatctcttagaaatcattgctaaagctggacctggtgctcaaatttcacctattgaaattgcttctcagctcccaacaaccctgatgcaccagttatgttggaccgaatgttgcgtcgcttggcttgttacaatatcctcacttgttcagttcgtactcaacaagatggaaagattcagagcctttatggtttggcgactgttgctaa

SEQ ID NO: 27439 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagatcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27440 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcacctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27441 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcaactcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27442 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaaccagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27443 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaaccagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27444 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaaacagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27445 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttgaaatcagctcttgaacttgatctcttagaaatcattgctaaagctggacctggtgctcaaatttcacctattgaaattgcttctcagctcccaacaactagcaccagttatgttggaccgaatgttgcgtctcttggcttgttacaatatcctcacttgttcagttcgtactcaacaagatggaaaggttcagagactttatggtttggctactgttgctaa

SEQ ID NO: 27446 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcgaaatcagctcttgaacttgatctcttagaaatcattgctaaagctgtaactggtgctcaaatttcacctattgaaattgcttctcagctaccaacaactgatgcaccagttatgttggaccgaatgtttcgtctcttggcttgttacaatatcctcacttgttcagttcgtactcaacaagatggaaaggttcagagactttatggtttggctactgttgctaa

SEQ ID NO: 27447 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcgaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaagttcagagactttatggtttggctgctgttgctaa

SEQ ID NO: 27448 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 27449 - DNA, 270 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcgaaatcagctcttgaacttgatctcttagaaatcattgctaaagctggacctggtgctcaaatttcacctattgaaattgcttctcaacaagatggaaaagttcagagactttatggtttggctactgttgctaa

SEQ ID NO: 27450 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27451 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27452 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27453 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttcaaaatcagctcttgaacttgatctcttagaaatcattgctaaagctggacctggtgctcaaatttcacctattgaaattgcttctcagctcccaaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27454 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27455 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27456 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcatggcttgttacaatatcctcacttgttcagttcgtactcaacaagatggaaaggttcagagactttatggtttggctactgttgctaa

SEQ ID NO: 27457 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaatcagctcttgaacttgatctcttagaaatcaatgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27458 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaaatcagctcttgaacttgatctcttagaaatcattgctaaagctggacctggtgctcaaatttcacctattgaaattgcttctcagctcccaacactctgatgcaccagttatgttggaccgaatgttgcgtctcttggcttgttacaatatcctcacttgtttagttcgtactcaacaagatggaaagattcagagactttatggtttggctactgttgctaa

SEQ ID NO: 27459 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27460 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatttaaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27461 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattgtgaaatcagctcttgaacttgatctcttagaaatcattgctaaagctggacctggtgctcaaatttcacctattgaaattgcttgcaccagttatgttggaccgaatgttgcgtctcttggcttgttacaatatcctcacttgttcagttcgtactcaacaagatggaaaggttcagagactttatggtttggctactgttgctaa

SEQ ID NO: 27462 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattgtaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27463 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattgtaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27464 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattctgaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27465 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattctaaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttcagttcgtactcaacaagatggaaagattcagagactttatggtttggctactgttgctaa

SEQ ID NO: 27466 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattctaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27467 - DNA, 422 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattctaaaatcagctcttgaacttgatctcttagaaatcattgctaaagctggacctggtgctcaaatttcacctattgaaattgcttctcagctcccaacaactacttgaccccggagcaggtggtggccatcgccagccacgatggcggcaacagccgctggactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27468 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattctaaaatcagctcttgaacttgatctcttagaaatcattgctaaagctggacctggtgctcaaatttcacctattgaaattgcttctcagctcccaacaactaaaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27469 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattctaaaatcagctcttgaacttgatctcttagaaatcattgctaaagctggacctggtgctcaaatttcacctattgaaattgcttctcagctcccaacaacacgcaattaatacgcgtaccgctagccaggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27470 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattctaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27471 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattctaaaatcagctcttgaacttgatctcttagaaatcattgctaaagctggacctggtgctcaaatttcacctattgaaattgcttctcagctaccaacaactaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27472 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattctaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcaattgttcagttcgtactcaacaagatggaaaagttcagagactttttggtttggctactgttgctaa

SEQ ID NO: 27473 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattctaaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaaagttcagagactttatggtttggctactgttgctaa

SEQ ID NO: 27474 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattctaaaatcagctcttgaacttgatctcttagaaatcattgctaaagctggacctggtgctcaaatttcacctattgaaattgcttctcaactcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27475 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattataaaatcagctcttgaacttgatctcttagaaatcattgctaaagctggacctggtgctcaaatttcacctattgaaattgcttctcagctcccaacatctgatgcaccagttatgttggaccgaatgttgcgtctcttggctcgttacaatatcctcacttgttcagttcgtactcaacaagatggaaagattcagagactttatggtttggctactgttgctaa

SEQ ID NO: 27476 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattataaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 27477 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgattataaaatcagctcttgaacttgatctcttagaaatcattgctaaagctggacctggtgctcaaatttcacctattgaaattgcttctcagctaccaacaactgatttgtcctactcaggagagcgttcaccgacaaacaacagataaaacgaaaggcatgcaccagttatgttggaccgaatgttgcgtctcttggcttgttacaatatcctcacttgttcagttcgtactcaacaagatggaaagattcagagactttatggtttggctactgttgctaa

SEQ ID NO: 27478 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatcttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27479 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatcttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgcactcaacaagatggaaagattcagagactttatggtttggctactgttgctaa

SEQ ID NO: 27480 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatcttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27481 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatcttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 27482 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatcttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27483 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgatcttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27484 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgactttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagaccttatggtttggctactgttgctaa

SEQ ID NO: 27485 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaatttaaaatcagctcttgaacttgatctcttagaaatcattgctaaagctggacctggtgctcaaatttcacctattgaaattgcttctcagctcccaacaagttatgttggaccgaatgttgcgtctcttggcttgttacaatatcctcacttgttcagttcgtactcaacaagatggaaagattcagagactttatggtttggctactgttgctaa

SEQ ID NO: 27486 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaatttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27487 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccatgaatttaaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27488 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccataattttaaaatcagctcttgaacttgatctcttagaaatcattgctaaagctggaccgaatgttgcgtctcttggcttgttacaatatcctcacttgttcagttcgtactcaacaagatggaaaggttcagagactttatggtttggctactgttgctaa

SEQ ID NO: 27489 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccaggattttaaaatcagctcttgaacttgatctcttagaaatcattgctaaagctggacctggtgctcaaatttcacctattgaaattgcttctcagctcccaacaacctgaggcaccagtgatgggggaccgaatgttgcgtctcttggcttgtgacaatatcctcacttgttcaggtcgtacgcaacaagatggaaaggttcagagactttatgggggggcgaaggttgctaa

SEQ ID NO: 27490 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcccacgattttaaaatcagctcttgaacttgatctcttagaaatcattgctaaagctggacctggtgctcaaatttcacctgttcaaattgcttctcagctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27491 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttccatgattttaaaatcagctcttgaacttgatttcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 27492 - DNA, 206 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttccatgattttaaaatcagctcttgaacttgatctacaagatggaaagattcagagactttatggtttggctactgttgctaa

SEQ ID NO: 27493 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttgaaatcagctcttgaacttgatctcttagaaatcattgctaaagctggacctggtgctcaaatttcacctgttcaaattgcttctcagcttccaacactgatgcaccagttatgttggaccgaatgttgcgtctcttggcttgttacaatatcctcacttgttcagttcgtactcaacaagatggaaagattcagagactttatggtttggctactgtttctaa

SEQ ID NO: 27494 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttgaaatcagctcttgaacttgatctcttagaaatcattgctaaagctggacctggtgctcaaatttcacctattgaaattgcttctcagctaccaacaacctgatgcaccagttatgttggaccggatgttgcgtctcttggcttgttacaatatcctcacttgttcagttcgtactcaacaagatggaaaggttcagagactttatggtttggctactgttgctaa

SEQ ID NO: 27495 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagtttccgagactttatggtttggctactgttgctaa

SEQ ID NO: 27496 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27497 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27498 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27499 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttccaatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27500 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcacatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27501 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcacatgattttaaaatcagctcttgaacttgatctcttagaaatcattgctaaagctggacctggtgctcaaatttcacctattgaaattgcttctcagcttccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27502 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcacatgattttaaaatcagctcttgaacttgatctcttagaaatcattgctaaagctggacctggtgctcaaatttcacctattgaaattgcttctcagctcccaaccccctgatgcaccagttatgttggaccgactgttgcgtctcttggcttgttacaatatcttcacttgttcagttcgtactcaacaatatggaaagattcagagactttatggtttggctactgttgctaa

SEQ ID NO: 27503 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcacatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27504 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcacatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27505 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcacatgattttaaaatcagctattgaacttgatctcttagaaataattgctaaagctggacctggtgatcaaatttcacctattgaaattgcttctcagctcccaacaaccctgatacaccagttatcttttaccgaatgtttcgtctcttaacttgttacaatatcctcacttattcatttcctactcaacaacatttaaaatttcagagactttatggtttagctactattcctaa

SEQ ID NO: 27506 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttcacatgattttaaaatcagatcttgaacttgatctcttagaaatcattgctaaaactagacctggtgctcaaatttcacctattgaaattgcttctcatctaccaacaacttatgcaccatttatgttttacctaatgtttcatctcttgtcttattacaatatcctcacttattcatttcctactcaacaagattgaaatattcacagactttatggtttagctacttttactaa

SEQ ID NO: 27507 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttaccatgattttgaaatcagctctatgttggaccgaatgttgcgtctcttggcttgttacaatatcctcacttgttcagttcgtactcaacaagatggaaaggttcagagactttatggtttggctactgttgctaa

SEQ ID NO: 27508 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttaccatgattttaaaatcagctcttgaacttgatctcttagaaatcattgctaaagctggacctggtgctcaaatttcacctgttcaaattgcttctcagctcccaacactgatgcaccagttatgttggaccgaatgttgcgtctcttggcttgttacaatatcctcacttgttcagttcgtactcaacaagatagaaaggttcagagactttatggtttggctactgttgctaa

SEQ ID NO: 27509 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcttaccatgattttaaaatcagctcttgaacttgatctcttagaaatcattgctaaagctgcacctgatgctcaaaattcaactgttcaaattgcttctcagcttccaacaaccctgatgcaccagtcatattggaccgaatgttgcgtctcttggcttgttacaatatcctcccttgttctgttcgtactcaacaatatggaaaggttcagagactttatggtttagctactgttgctaa

SEQ ID NO: 27510 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttgaaatcagctcttgaacttgatctcttagaaatcattgctaaagctggacctggtgctcaaatttcacctattgaaattgcttctcagctaccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27511 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttgaaatcagctcttgaacttgatctcttagaaatcattgctaaagctggacctggtgctcaaatttcacctattgaaattgcttctcagctaccaacaacttgcgtctcttggcttgttacaatatcctcacttgttcagttcgtactcaacaagatggaaaggttcagagactttatggtttggctactgttgctaa

SEQ ID NO: 27512 - DNA, 248 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttatgttggaccgaatgttgcgtctcttggcttgttacaatatcctcacttgttcagttcgtactcaacaagatggaaagattcagagactttatggtttggctactgttgctaa

SEQ ID NO: 27513 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttaaaatcagctcttgaacttgatctcttagaaatcattgctaaagctgtacctggtgctcaaatttctcctattgaaattgcttctcagctaccaacagcttatgcacctgttatgttggaccgaatattgagtctcttggcttgttacaatatcctcactttttaagttcgtactcaacaagattgaaaggttcagagactttatggtttggctacagttgctaa

SEQ ID NO: 27514 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27515 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27516 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgccaa

SEQ ID NO: 27517 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttctccccatgattttaaaatcagctcttgaacttgatctcttagaaatcattgccaaagctggacctggtgctcaaatttcacctattgaaattgcttctcagctcccaacagctatgcaccagttatgttggaccgaatgttgcgtctcttggcttgttgcaatatcctcacttgtgcaggtcgtactcagcaagatggaaaggttcagagactttatggtttggctactgttgctaa

SEQ ID NO: 27518 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttctcaccatgattttaaaatcagctcttgaactttatctcttagaaatcattgctaaagctggacctggtgctcatatttcacctattgaaattgcttctcagctacctgatgcaccagttatgttgtaccgaatgttgcgtcacttggcttgttacaatatcctcacttgttcagttcgtactcaacaagattgaaaggttcagagcctttatggtttggctactgttgataa

SEQ ID NO: 27519 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttctacccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27520 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttctacccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27521 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagttcctcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27522 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagtcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27523 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagtccttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27524 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagctcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27525 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagctcttcccatgattttaaaatcagctcttgaacttgatctcttagaaatcattgctaaagctggacctggtgctcaaatttcacctattgaaattgcttcttggaccgaatgttgcgtctcttggcttgttacaatatcctcacttgttcagttcgtactcaacaagatggaaagattcagagactttatggtttggctactgttgctaa

SEQ ID NO: 27526 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagatcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27527 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttcagatcttcccatgattgtgaaatcagctcttgaacttgatctcttagaaatcattgctaaagctggacctggtgctcaaatttcacatattgaaattgctactcagctcccaacaacccagatgtagcagatatgttgtaccgaatgttgcgtcttttggcttgttacaatatcctcacatgatatgttcgtactcaacaagatggaaagtttcacagactttatggtttggctacttgtgctaa

SEQ ID NO: 27528 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttaagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27529 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcttaagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27530 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgctccagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27531 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgctccagttcttcccatgattttaaaatcagctcttgaacttgatctcttagaaatcattgctaaagctggacctggtgctcaaatttcacctgttcaaattgcttctcagctcccaacaactgatgcaccagttatgttggaccgaatgttgcgtctctttgcttgttacaatatcctcacttgttcagttcgtactcaacaagatggaaaggttcagagactttatggtttggctactgttgctaa

SEQ ID NO: 27532 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgctccagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27533 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgctccagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27534 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgctacagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27535 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgctacagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27536 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgctacagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27537 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcgtcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27538 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcctcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27539 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcctcagttcttcccatgattttaaaatcagctcttgaacttgatctcttagaaatcattgctaaagctggacctggtgctcaaatttcacctattgaaattgcttctcagctcccaaccagttatgttggaccgaatgttgcgtctcttggcttgttacaatatcctcacttgttcagttcgtactcaacaagatggaagggttcagagactttatggtttggctactgttgctaa

SEQ ID NO: 27540 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcctcagttcttcccatgattttaaaatcagctcttgaacttgatctcttagaaatcattgctaaagctggacctggtgctcaaatttcacctattgaaattgcttctcagctcccaacaactaaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27541 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcctcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27542 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcctcagttcttcccatgattttaaaatcagctcttgaacttgatctcttagaaatcattgctaaagctggacctggtgctcaaatttcacctattgaaattgcttctcagctcccaacaacccctgatgcaccagttatgttggaccgaatgttgcgtctcttggcttgttacaatatcctcacttgttcagttcgtactcaacaagatggaaaggttcagagacttatggtttggctactgttgctaa

SEQ ID NO: 27543 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcctcagttcttcccatgattttaaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27544 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcatcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27545 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgcatcagttcttcccatgattttaaaatcagctcttgaacttgatctcttagaaatcattgctaaagctggacctcgtgctcaaatttcacctattgaaattgcttctcaggatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27546 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtgattcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27547 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtccttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27548 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtacttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27549 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtacttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27550 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagtacttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27551 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccattattttgaaatcagctcttgaacttgatctcttagaaatcattgctaaagctggacctggtgctcaaatttcacctattgaaattgcttctcagctcccaaaatgcaccagttatgttggaccgaatgttgcgtctcttggcttgttacaatatcctcacttgttcagttcgtactcaacaagatggaaaggttcagagactttatggtttggctactgtagctaa

SEQ ID NO: 27552 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttgaaatcagctcttgacttgttacaatatcctcacttgttcagttcgtactcaacaagatggaaagattcagagactttatggtttggctactgttgctaa

SEQ ID NO: 27553 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttgaaatcagctcttgaacttgatctcttagaaatcatttctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27554 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttgaaatcagctcttgaacttgatctcttagaaatcattgctaaagctggacctggtgctcaaatttcacctattgaaattgcttctcagctcccaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27555 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttgaaatcagctcttgaacttgatctcttagaaatcattgctaaagctggacctggtgctcaaatttcacctattgaaattgcttctcagctcccaacaactaacctgatgcaccagtgatgttggaccgaatgttgcgtctcttggcttgttacaatatcctcacttgttcagttcgtactcaacaagatggaaagattcagagactttatggtttggctactgttgctac

SEQ ID NO: 27556 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctccaatttcaactattgaaattgcttctcagctacctcctgatgcaccagttatgttggaccgaatgttgcgtctcttggcttgttacaatatcctcacttgttcagttcgtactcaacaagatggaaaaattcagagactttatggtttggctactgttgctaa

SEQ ID NO: 27557 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctgttcaaattgcttctcagcttccaacaactaatgcacctgtcatgttggaccgaatgttgcgtctcttggcttgttacaatatcctcacttgttctgttcgtactcaacaagatggaaaggttcagagactttatggtttggctactgttgctaa

SEQ ID NO: 27558 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctgttcaaattgcttctcagcttccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27559 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctgttcaaattaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27560 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcatctcccaacaactaacctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 27561 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27562 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctcccaacaccccagcaggtggtggccatcgccagcaatggcggtggcaagcaggcgctggagacggtccagcggctgttgccggtgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27563 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctcccaacaactaaccctgttggaccgaatgttgcgtctcttggcttgttacaatatcctcacttgttcatttcgtactcaacaagatggaaagattcagagactttatggtttggctactgttgctaa

SEQ ID NO: 27564 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27565 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctcccaacaacccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27566 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctaccgacaactcagtgccaaatgtttgagcgatcgcgccctgctgatgcaccagttaggttggaccgaaggttgcgtcgcttggcttggtacaatatcgtcacttgttcagttcgtactcaacaagatggaaagattcagagactttagggtttgctactgttgctaa

SEQ ID NO: 27567 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctaccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27568 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27569 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27570 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27571 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27572 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaaggacttcagttcttcccatgattttaaaatcagctcttgaacttgatctcttagaaatcattgctaaagctagacctggtactcaaatttcacctattgaaattgcttctcagctaccaacaactgatgcaccagttatgttggaccgaatgttgcgtctcttggcttgttacaatatcctcacttgttcagttcgtactcaacaagatggataggttcacagactttatggtttggctactgttgctaa

SEQ ID NO: 27573 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagcgcttcagttcttcccatgattttaaaatcagctcttgaacttgatctcttagaaatcattgctaaagctggacctggtgctcaaatttcacctattgaaattgcttctcagctcctaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27574 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagagcttcagttcttcccatgattttaaaatcagctcttgaacttgatctcttagaaatcattgctaaagctggatctggtgctcaaatttcacctattgaaattgcttctcagctcccaacaactgatgcaccagttatgttggaccgaatgttgcgtctcttggcttgttacaatatcctcacttgttcagttcttactcaacaagatggaaaggttcagagactttatggtttggctactgttgctaa

SEQ ID NO: 27575 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27576 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27577 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaagagcttcagttcttcccatgattttaaaatcagctcttgaacttgatctcttagaaatcattgctaaagctggacctggtgctcaaatttcacctattgaaattgcttctcagctaccaacaactctccaggggaagccgaagtttccaaaaggtcgttgatcaaagctcgccgcgttgtttcctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 27578 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaactgcttcagttcttcccatgattttaaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaagttcagagactttatggtttggcgactgttgcgaa

SEQ ID NO: 27579 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaaatgcttcagttcttcccatgattttaaaatcagctcttgaacttgatctcttagacatcattgctaaagctggacctggtgatcaaatttcacctgttcaaattgcttctcagctcccaacaactgatgcaccagttatgttggaccgaatgttgcgtctcgtggcttgttacaatatcctcacttgttcagttcgtacgcaacaagatggaaaaattcagagacgttagcgtttggctactgttcctaa

SEQ ID NO: 27580 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagcaaatgcttcagttcttcccatgattttaaaatcagctcttgaacttgatctcttagaaatcattgctaaagctggacctggtgctcaaatttcacctattgaaattgcttctcagctcccaacacctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 27581 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattagaaagtgcttcagttcttcccatgattttaaaatcagctattgaacttgatctcttagaaatcattgctaaagctggaccttgtgctcaaatttcacctattgaaattgcttctcagctcccaacaacctgatgcaccagttatgttggaccgaatgttgcgtctcttggcttgttacaatatcctcacttgttcagttcgtactcaacaagatggaaaatttcagagactttatggtttggcgactgttgctaa

SEQ ID NO: 27582 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaccaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27583 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaccaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtcacttgggttgttacaatatcctcacttgttcagttcgtactcagcaagatggaaaggttcagagaatttatggtttggctactgttgctaa

SEQ ID NO: 27584 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaccaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27585 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaccaagtgcttcagttcttcccatgattttaaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27586 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27587 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttgaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaaggttcagagactttatggtttggctactgttgctaa

SEQ ID NO: 27588 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaatcattgctaaagctggacctggtgctcaccagttatgttggaccgaatgttgcgtctcttggcttgttacaatatcctcacttgttcagttcgtactcaacaagatggaaaggttcagagactttatggtttggctactgttgctaa

SEQ ID NO: 27589 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27590 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27591 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27592 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 27593 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27594 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27595 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27596 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaggttcagagactttatggttggctactgttgctaa

SEQ ID NO: 27597 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27598 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaattaacaagtgcttcagttcttcccatgattttaaaatcagctcttgaacttgatctcttagaaatcattgctaaagctggaccgggtgatcaaatttcacctattgaagttgcttcacagctaccaacaaccctgatgcaccagttatgttgggccgaatgttgcgtctcttggcttgttacaatatcctcacttgttcagttcgtaatcaacaagatggaaaggttcagagcctttatggtttggctactgttgctaa

SEQ ID NO: 27599 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaatcagcaagtgcttcagttcttcccatgattttaaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27600 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaatcagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27601 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaatagcaaatgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27602 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaataagcaagtgcttcagttcttcccatgattttaaaatcagctcttgaacttgatctcttagaaatcattgctaaagctggacctggtgctcaccagttatgttggaccgaatgttgcgtctcttggcttgttacaatatcctcacttgttcagttcgtactcaacaagatggaaagattcagagactttatggtttggctactgttgctaa

SEQ ID NO: 27603 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaagtagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaagttcagagactttatggtttggctactgttgctaa

SEQ ID NO: 27604 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaagtagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 27605 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaagtagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctctcttgttcagttcgtactcaacaagatggaaaggttcagagactttatggtttggctactgttgctaa

SEQ ID NO: 27606 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaacttgcaagtgcttcagttcttcccatgattttaaaatcagctcttgaacttgatctcttagaaatcattgctaaagcttgacctggtgctcaaatttcacctgttcaaattgcttctcttggcttgttacaatatcctcacttgttctgttcgtacccaacaagatggaaaagttcagagactttatggtttggctactgttgctaa

SEQ ID NO: 27607 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactggcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27608 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactggcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27609 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactggcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27610 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactcgcaagtgcttcagttcttcccatgattttgaaatcagctcttgaacttgatctcttagaaatcattgctaaagctggacctggtgctcaaatttcacctattgaaattgcttctcagctaccaacaaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27611 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagtaagtgcttcagttcttcccatgattttgaaatcagctcttgaacttgatctcttagaaatcattgctaacgctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27612 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagctagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27613 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagctagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27614 - DNA, 331 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagctagtgcttcagttcttcccatgattttgaaatcagctcttgaacttgatctcttagaaatcattgctaaagctggacctggtgctcaaatttcacctattgaaaccagttatgttggaccgaatgttgcgtctcttggcttgttacaatatcctcacttgttcagttcgtactcaacaagatggaaaggttcagagactttatggtttggctactgttgctaa

SEQ ID NO: 27615 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcgagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27616 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcatgtgcttcagttcttcccatgattttgaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaagattcagagcctttatggtttggctactgttgctaa

SEQ ID NO: 27617 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcatgtgcttcagttcttcccatgattttgaaatcagctcttgaacttgatctcttagaaatcattgctaaagctggacctggtgctcaaatttcacctattgaaattgcttctcagctaccaacgactgggcctttcgttttatctgttgtttgtcggtgaacgctctccctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 27618 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaggtgcttcagttcttcccatgattttgaaatcagctcttgaacttgatctcttagaaatcattgctaaagctggacctggtgctcaaatttcacctattgaaattgcttctcagctaccaacaactgcaccagttatgttggaccgaatgttgcgtctcttggcttgttacaatatcctcacttgttcagttcgtactcaacaagatggaaagattcagagactttatggtttggctactgttgctaa

SEQ ID NO: 27619 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcacgtgcttcagttcttcccatgattttgaaatcagctcttgaacttgatctcttagaaatcattgctaaagctggacctggtgctcaaatttcacctattgaaattgcttctcagctaccaacaactgcaccagttatgttggaccgaatgttgcgtctcttggcttgttacaatatcctcacttgttcagtgcgtactcaacaagatggaaaggttcagagactttatggtttggctactgttgctaa

SEQ ID NO: 27620 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27621 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaattgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttaaggtttggctacttgttgctaa

SEQ ID NO: 27622 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagttcttcagttcttccgatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcaggtcgtactcaacaagatggaaaagttcagagactttatggtttggctactgtagctaa

SEQ ID NO: 27623 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggacctaatgttgcgtctcttggcttgttacaatatcctcacttgttcagttcgtactcaacaagatggaaaggttcagagactgtatggtttggctactgttgctaa

SEQ ID NO: 27624 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27625 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagttcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactttgctaa

SEQ ID NO: 27626 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgctttagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27627 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgctttagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27628 - DNA, 445 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttctgttcttcccatgattttgaaatcagctcttgaacttgatctcttagaaatcattgctaaagctggacctggtgctcaaatttcacctattgaaattgcttctcagctcccaacaactagcaatggcggtggcaagcaggcgctggagactgcatgcatggcgcaatgcactgacgggtgccccgctcaacttgaccccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27629 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcggttcttcccatgattttgaaatcagctcttgaacttgatctcttagaaatcattgctaagctggacctggtgctcaaatttcacctattgaaattgcttgtcagctcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27630 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcggttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27631 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcggttcttcccatgattttgaaatcagctcttgaacttgatctcttagaaatcattgctaaagctggacctggtgctcaaatttcacctattgaaattgcttctcagctaccaacaagcaccagttatgttggaccgaatgttgcgtctcttggcttgttacaatatcctcacttgttcagttcgtactcaacaagatggaaaggttcagagactttatggtttggctactgttgctaa

SEQ ID NO: 27632 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcggttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27633 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcggttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27634 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagtttttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27635 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttttcccatgattttaaaaacagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27636 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttctttctatgattttgaaatcagctcttgaacttgatctcttagaaatcattgctaaagctggacctggtgctcaaatttcacctgttcaaattgcttctcagcttccaacaactaatgcaccagtcatgttggaccgaatgttgcgtctcttggcttgttacaatatcctcacttgttctgttcgtactcaacaagatggaaagattcagagactttatggtttggctactgttgctaa

SEQ ID NO: 27637 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttctttccatgattttgaaatcagctcttgaacttgatctcttagaaatcattgctaaagctggacctggtgctcaaatttcacctattgaaattgcttctcagctaccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27638 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttctttccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27639 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttctcatgattttgaaatcagctcttgaacttgatctcttagaaatcattgctaaagctggaccttgtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27640 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttctcatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27641 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttctcatgattttgaaatcagctcttgaacttgatctattagaaatcattgctaaagctggacctggtgctcaaatttcacctattgaaattgcttctcagctcccaacaacccttatgcaccagttatatttgaccgaatgtttcgtctcttttctttttacaatatcctcacttgttcatttcgtactcaacaagatttaaagattcagagactttattgtttccctactgttgctaa

SEQ ID NO: 27642 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttctcatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27643 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcgcatgattttgaaatcagctcttgaacttgatctcttagaaatcattgctaaagctggacctggtgctcaaatttcacctattgaaattgcttctcagctaccaccgaatgttgcgtctcttggcttgttacaatatcctcacttgttcagttcgtactcaacaagatggaaaggttcagagactttatggtttggctactgttgctaa

SEQ ID NO: 27644 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcctatgattttaaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27645 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttccgatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27646 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccttgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27647 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccgtgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27648 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccgtgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27649 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccgtgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27650 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccgtgattttaaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27651 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccattattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27652 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccattattttgaaatcagctcttgaacttgatctcttagaaatcattgctaaagctggacctggtgctcaaatttcacctattgaaattgcttctcagctaccaacaactgatgcaccagttatgttggaccgaatgttacgtctcttggcttgttacaatatcctcacttgttcagttcgtactcaacaagatggaaaagttcagagactttatggtttggctactgttgctaa

SEQ ID NO: 27653 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccattattttgaaatcagctcttgaacttgatctcttagaaatcattgctaaagctggacctggtcctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27654 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgtttttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27655 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatggttttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27656 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatggttttgaaatcagctcttgaacttgatctcttagaaatcattgctaaagctggacctggtgctcaaatttcacctattgaaattgcttctcagctaccaacaattgcaccagttatgttggaccgaatgttgcgtctcttggcttgttacaatatcctcacttgttcagttcgtactcaacaagatggaaagattcagagactttatggtttggctactgttgctaa

SEQ ID NO: 27657 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatggttttgaaatcagctcttgaacttgatctcttagaaatcattgctaaagctgagttatgttggaccgaatgttgcgtctcttggcttgttacaatatcctcacttgttcagttcgtactcaacaagatggaaaggttcagagactttatggtttggctactgttgctaa

SEQ ID NO: 27658 - DNA, 342 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttttaaatcagctcttgaacttgatctcttagaaatcattgctaaagctggacctggtgctcaaatttcacctattgaaattgcttctcagctaccaacgttggaccgaatgttgcgtctcttggcttgttacaatatcctcacttgttcagttcgtactcaacaagatggaaagattcagagactttatggtttggctactgttgctaa

SEQ ID NO: 27659 - DNA, 415 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttttaaatcagctcttgaacttgatctcttagaaatcattgctaaagctggacctggtgctcaaatttcacctattgaaattgcttctcagctaccaacaactaacgccattatctcagacgcactgaaccacgcgtctattattgatggtgtgcgctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27660 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgtaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27661 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgtaatcagctcttgaacttgatctcttagaaatcattgctaaagctggacctggtgctcaaatttcacctattgaaattgcttctcagctaccaacaactgatgcaccagttatgttggactgaatgttgcgtctcttggcttgttacaatatcctcacttgttcagttcgtactcaacaagatggaaaggttcagagactttatggtttggctactgttgctaa

SEQ ID NO: 27662 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttggaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27663 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttggaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27664 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttggaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttcagttcgtactcaacaagatggaaaggttcggagactttatggtttggctactgttgctaa

SEQ ID NO: 27665 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttggaatcagctcttgaacttgatctcttagaaatcattgctaaagctggacctgctgctccaatttaacctattgaaattgcttctcagctaccaacaacctgatgcaccagttatgttggaccgaatgttgcgtctcttggcttgttacaatatcctcacttgttcagttcctactcagcaagatggaaaggttcggagtcattatggtttggctactcttgctac

SEQ ID NO: 27666 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgcaatcagctcttgaacttgatctcttagaaatcattgctaaagctggacctggtgctcaaatttcacctattgacttgttacaatatcctcacttgttcagttcgtactcaacaagatggaaaggttcagagactgtatggtttggagactgttgctaa

SEQ ID NO: 27667 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgagatcagctcttgaacttgatctcttggcttgttacaatatcctcacttgttcagttcgtactcaacaagatggaaaagttcagagactttatggtttggctactgttgctaa

SEQ ID NO: 27668 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgagatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27669 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgagatcagctcttgaacttgatctcttagaaatcattgctaaagctggacctggtgctcaaatttcacctattgaaattgcttctcagctaccaacaacatgcaccagttatgttggaccgaattttgcgtctcgtggcttgtgacaatatcctcacttgttcagttcgtactcaacaagatggaaaggttcagagactttatggtttggctactgttgctaa

SEQ ID NO: 27670 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaattcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27671 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaattcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27672 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaagtcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27673 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaagtcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27674 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaactcagctcttgaacttgatctcttagaaatcattgctaaagctggacctggtgctcaaatttcacctattgaaattgcttctcagctaccaacaaccggatgcaccagttatgttggaccgaatgttgcgtctctgggcttgttacaatatcctcacttgttcagttcgtactcaacaagatggaaaggttcagagactttatggtttggctactgttgctaa

SEQ ID NO: 27675 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaattagctcttgaacttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27676 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaattagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 27677 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatgagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27678 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcatctctatgttggaccgaatgttgcgtctcttggcttgttacaatatcctcacttgttcagttcgtactcaacaagatggaaaggttcagagactttatggtttggctactgttgctaa

SEQ ID NO: 27679 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagttcttgaacttgatctcttagaaatcattgctaaagctggaccttgtgctcaaatttcacctattgaaattgcttctcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27680 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagttcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27681 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctttaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 27682 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctttaacttgatctcttagaaatcattgctaaagctggacctagtgctcaaatttcacctattgaaattgcttctcagctcccaacactgatggaccagttatgttggaccgaatgttgcgtctcttggcttgttacaatatcctcacttgttcagttcgtactcaacaagatggaaaggttcagagactttatggtttggctactgttgctaa

SEQ ID NO: 27683 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgtacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27684 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgtacttgatctcttagaaatcattgctaaagctggacctggtgctcaaatttcacctattgaaattgcttctcagctaccaacaactaaacgcaaaaaggccatccgtcaggatggccttctgcttagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27685 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttggcttgttacaatatcctcacttgttcagttcgtactcaacaagatggaaaggttcagagactttatggtttggctactgttgctaa

SEQ ID NO: 27686 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttggacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27687 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagcttgatctcttagaaatcattgctaaagctggacctggtgctcaaatttcacctattgaaattgcttctcagctcccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27688 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagcttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27689 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagcttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27690 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagcttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27691 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgagcttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27692 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgacttgttacaatatcctcacttgttcagttcgtactcaacaagatggaaaggttcagagactttatggtttggctactgttgctaa

SEQ ID NO: 27693 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgacttgttacaatatcctcacttgttcagttcgtactcaacaagatggaaagattcagagactttatggtttggctactgttgctaa

SEQ ID NO: 27694 - DNA, 234 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgacttgttacaatatcctcacttgttcagttcgtactcaacaagatggaaagattcagagactttatggtttgctactgttgctaa

SEQ ID NO: 27695 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgacttgttacaatatcctcacttgttcagttcgtactcaacaagatggaaaagttcagagactttatggtttggctactgttgctaa

SEQ ID NO: 27696 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaatttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 27697 - DNA, 270 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaatttgatctcttagaaatcattgctaaagctggacctggtgctcaaatttcacctattgaaattgcttctcaacaagatggaaaagttcagagactttatggtttggctactgttgctaa

SEQ ID NO: 27698 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactttatctcttagaaatcattgctaaagctggacctggtgctcaaatttcacctattgaaattgcttctcagctaccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27699 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgttctcttagaaatcattgctaaagctggacctggtgctcaaatttcacctattgaaattgcttctcagctaccaacatgcaccagttatgttggaccgaatgttgcgtctcttggcttgctacaatatcctcacttgttcagttcgtactcaacaagatggaaaggttcagagactttatggtttggctactgttgctaa

SEQ ID NO: 27700 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttggtctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27701 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttggtctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27702 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatttcttagaaatcattgctaaagctggacctggtgctcaaatttcacctattgaaattgcttctcagctccagttatgttggaccgaatgttgcgtctctgggcttgttacaatatcctcacttgttcagttcgtactcaacaagatggaaaggttcagagactttatggtttggctactgttgctaa

SEQ ID NO: 27703 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatttcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27704 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggaccgaatgttgcgtctcttggcttgttacaatatcttcacttgttcagttcgtactcaacaagatggaaaagttcagagactttatggtttggctactgttgctaa

SEQ ID NO: 27705 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggaccgaatgttgcgtctcttggcttgttacaatatcctcacttgttctgttcgtactcaacaagatggaaaggttcagagactttatggtttggctactgttgctaa

SEQ ID NO: 27706 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggaccgaatgttgcgtctcttggcttgttacaatatcctcacttgttcagttcgtactcaacaagatggaaaggttcagagactttatggtttggctactgttgctaa

SEQ ID NO: 27707 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggaccgaatgttgcgtctcttggcttgttacaatatcctcacttgttcagttcgtactcaacaagatggaaaggttcagagactttatggtttggcaactgttgctaa

SEQ ID NO: 27708 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggaccgaatgttgcgtctcttggcttgttacaatatcctcacttgttcagttcgtactcaacaagatggaaagattcagagactttatggtttggctactgttgctaa

SEQ ID NO: 27709 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctggaccgaatgttgcgtctcttggcttgttacaatatcctcacttgttcagttcgtactcaacaagatggaaaagttcagagactttatggtttggctactgttgctaa

SEQ ID NO: 27710 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggcttgttataatatcctcacttgttcagttcgtactcaacaagatggaaaggttcagagactttatggtttggctactgttgctaa

SEQ ID NO: 27711 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggcttgttacaatatcctcacttgttctgttcgtactcaacaagatggaaaggttcagagactttatggtttggctactgttgctaa

SEQ ID NO: 27712 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggcttgttacaatatcctcacttgttcagttcgtactcaacaagatggaaaggttcagagactttatggtttggctactgttgctaa

SEQ ID NO: 27713 - DNA, 247 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggcttgttacaatatcctcacttgttcagttcgtactcaacaagatggaaaggttcagagactttatggtttggctacgttgcaa

SEQ ID NO: 27714 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggcttgttacaatatcctcacttgttcagttcgtactcaacaagatggaaaggttcagagactttatggtttgctactgtttgctaa

SEQ ID NO: 27715 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggcttgttacaatatcctcacttgttcagttcgtactcaacaagatggaaagattcagagactttatggtttggctactgttgctaa

SEQ ID NO: 27716 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggcttgttacaatatcctcacttgttcagttcgtactcaacaagatggaaaagttcagagactttatggtttggctactgttgctaa

SEQ ID NO: 27717 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggcttgttacaatatcctcacttgttcagttcgtactcaacaagacggaaaggttcagagactttatggtttggctactgttgctaa

SEQ ID NO: 27718 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggcttgttacaatatccgcacttgttcagttcgtactcaacaagatgtaaaggttcagagactttatggtttggctactgttgctaa

SEQ ID NO: 27719 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27720 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggaaatcattgctaaagctggacctggtgctcaaatttcacctattgaaattgcttctcagctaccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27721 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27722 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttcgaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27723 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27724 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27725 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaatcattgctaaagctggacctggtgctcaaatttcacctattgaaattgcttctcagctaccaacaacttgcaccagttatgttggaccgaatgttgcgtctcttggcttattacaatatcctcacttgttcagttcgtactcaacaagatggaaaagttcagagactttatggtttggctactgttgctaa

SEQ ID NO: 27726 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27727 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27728 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttataaatcattgctaaagctggacctggtgctcaaatttcacctattgaaattgcttctcagctaatgcaccagttatgttggacctaatgttgcgtctcttggcttgttacaatatcctcacttgttcagttcgtactcaacaagatggaaaggttcagagactttatggtttggctactgttgctaa

SEQ ID NO: 27729 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagtaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 27730 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27731 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggaatcattgctaaagctggacctggtgctcaaatttcacctattgaaattgcttctcagctcccaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27732 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaggaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27733 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagcaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27734 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagatatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27735 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagatcattgctaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27736 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagagatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27737 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagacatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27738 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaattcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27739 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagtcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27740 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagtcattgctaaagctggacctggtgctcaaatttcacctattgaaattgcttctcagctcccaacaactaaccctgttggaccgaatgttgcgtctcttggcttgttacaatatcctcacttgttcagttcgtactcaacaagatggaaagattcagagactttatggtttggctactgttgctaa

SEQ ID NO: 27741 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaagtcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27742 - DNA, 294 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacctgatgcaccagttatgttggaccgaatgttgcgtctcttggcttgttacaatatcctcacttgttctgttcgttctcaacaagatggaaaggttcagagactttatggtttggctactgttgctaa

SEQ ID NO: 27743 - DNA, 294 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27744 - DNA, 294 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27745 - DNA, 294 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27746 - DNA, 294 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27747 - DNA, 294 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaacctgatgcaccagttatgttggaccgaatgttgcgtctcttggcttgttacaataacctcacttgttcagttcgtactcaacaagatggaaaggttcagagactttatggtttggctactgttgctaa

SEQ ID NO: 27748 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaattattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27749 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatctttgctaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27750 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatccttgctaaagctggacctggtgctcaaatttcacctattgaaattgcttctcagctaccaacaaatgcaccagttatgttggaccgaatgttgcgtcacttggcttgttacaatatcctcacttgttcagttcgtactcaacaagatggaaaggttcagagactttatggtttggctactgttgctaa

SEQ ID NO: 27751 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttctaaagctggacctggtgctcaaatttcacctattgaaattgcttctcagctcccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27752 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatttctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27753 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgttaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27754 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgttaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27755 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgttaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27756 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgcttaagctggacctggtgctcaaatttcacctattgaaattgcttctcagctaccagttatgttggaccgaatgttgcgtctcttggcttgttacaatatcctcacttgttcagttcgtactcaacaagatggaaaggttcagagactttatggtttggctactgttgctaa

SEQ ID NO: 27757 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgcttaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27758 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctgaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27759 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctgaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27760 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctgaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27761 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctcaagctggacctggtgctcaaatttcacctattgaaattgcttctcagctaccaacagcgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27762 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaatgctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27763 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaatatgcaccagttatgttgggccgaatgttgcgtctcttggcttgttacaatatcctcacttgttcagttcgtactcaacaagatggaaaggttcagagactttatggtttggctactgttgctaa

SEQ ID NO: 27764 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaatatgcaccagttatgttggaccgactgttgcgtctcttggcttgttacaatatcctcacttgttcagttcgtactcaacaagatggaaaggttcagagactttatggtttggctactgttgctaa

SEQ ID NO: 27765 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaatatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27766 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 27767 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27768 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaatatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27769 - DNA, 301 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaatatgcaccagttatgttggaccgaatgttgcgtctcttggcttgttacaatatcctcacttgttcagttcgtactcaacaaaatgaaaaggttcaaagacttatggtttggctactgttgctaa

SEQ ID NO: 27770 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaatacgcaccagttatgttggaccgaatgttgcgtctcttggcttgttacaatatcctcacttgttcagttcgtactcaacaagatggaaaggttcagagactttatggtttggctactgttgcgaa

SEQ ID NO: 27771 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaggctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27772 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaggctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27773 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaggctggacctggtgctcaaatttcacctattgaaattgcttctcagctcccaaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27774 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaggctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27775 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaggctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27776 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaagctggacttggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27777 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27778 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaatctggacctggtgctcaaatttcacatattgaaattgcttctcagctaacaacaactgatgcaccagttatgttgaaccgaatattccgtctcttcacttattacaatatcctcacttcttcacttcttactcaacaaaattcaaatattcagagactttattgtttaactactgttcctaa

SEQ ID NO: 27779 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagttggatctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27780 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagttggacctggtgctcaaatttcacctattgaaattgcttctcagctcccaacactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27781 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagttggacctggtgctcaaatttcacctattgaaattgcttctcagctaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27782 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagttggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctaatgttgctaa

SEQ ID NO: 27783 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagttggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27784 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagttggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 27785 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagttggacctggtgctcaaatttcacctattgaaattgcttctcagctaccaacaactgatgcaccagttatgtttgaccgaatgttgcgtctcttggtttgttacaatatcctcacttgttcagttcgtactcaacaagatggaaaggttcagagactttatggtttggctactgttgctaa

SEQ ID NO: 27786 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagttggaccgaatgttgcgtctcttggcttgttacaatatcctcacttgttctgttcgtactcaacaagatggaaaggttcagagcctttatggtttggctactgttgctaa

SEQ ID NO: 27787 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagttggaccgaatgttgcgtctcttggcttgttacaatatcctcacttgttcagttcgtactcaacaagatggaaaggttcagagactttatggtttggctactgttgctaa

SEQ ID NO: 27788 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagttggaccgaatgttgcgtctcttggcttgttacaatatcctcacttgttcagttcgtactcaacaagatggaaagattcagagactttatggtttggctactgttgctaa

SEQ ID NO: 27789 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagttggaccgaatgttgcgtctcttggcttgttacaatatcctcacttgttcagttcgtactcaacaagatggaaaagttcagagactttatggtttggctactgttgctaa

SEQ ID NO: 27790 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagcttgacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27791 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagcttgacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27792 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgtacctggtgctcaaatttcacctattgaaattgcttctcagctcccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27793 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgtacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27794 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgtacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27795 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgtacctggtgctcaaatttcacctattgaaattgcttctcagctaccaacaactgatgcaccagttatgttggaccgaatgttgcgtctcttggcttgttacaatatcctcacttgttcagttcgtaatcaacaagatggaaaggttcagagactttatggtttggctactgttgctaa

SEQ ID NO: 27796 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgtacctggtgctcaaatttcacctattgaaattgcttctcagctaccaacaactgatgcaccagttatgttggaccgaatgttgcgtctcttggcttgttacaatatcctcacttgttcagttcgtactcaacaagatagaaaagttcagagactttatggtttggctactgttactaa

SEQ ID NO: 27797 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgtacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27798 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgtacctggtgctcaaatttcacctattgaaattgcttctcagctaccaacaactgatgcaccagttatgttggaccgaattttgcgtctcttggattgttacaatatcctcacttgttcagttcgtactcaacaagatggaaaagttcagagactttatggtttggctactgttgctaa

SEQ ID NO: 27799 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggtcctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27800 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggtcctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27801 - DNA, 337 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27802 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgaaattgcttctcagctcccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27803 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27804 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgaaattgcttctcagctcccaacaactaacctgggcggctccaggaagcccgacggcgccatctacaccgtgggctcccccatcgactacggcgtgatcgtggacaccaaggcctactccggcggctacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27805 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27806 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgaaattgcttctcagctaccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27807 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27808 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27809 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27810 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27811 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgggcctggtgctcaaatttcacctattgaaattgcttctcagctaccaacaacatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27812 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggccctgttgctcaaatttcatctattgaaattgcttctcagctaccaacaacgaaccagttatgttggaccgaatgttgcgtctcttggcttgttacaatatcctcacttgttcagttcgtactcaacaagatggaaagattcagagactttatggtttggctactgttgctaa

SEQ ID NO: 27813 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggatctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27814 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggatctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27815 - DNA, 325 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggagccggtccagcggcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27816 - DNA, 325 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggagacggtccagcggcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27817 - DNA, 325 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggagacggtccagcggcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27818 - DNA, 325 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggagacggtccagcggcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27819 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccttgtgctcaaatttcacctattgaaattgcttctcagctaccaacatgcaccagttatgttggaccgaatgttgcgtctcttggcttgttacgatatcctcacttgttcagttcgtactcaacaagatggaaaggttcagagactttatggtttggctactgttgctaa

SEQ ID NO: 27820 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccttgtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgtt

SEQ ID NO: 27821 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccttgtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27822 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccttgtgctcaaatttcacctattgaaattgcttcccagctaccaacaactgatgcaccagttatgttggaccgaatgttgcgactcttggcttgttacaatatcctcacttgttcagttcctactcaacaagatggaaagattcagagactttatggtttggctactgttgctaa

SEQ ID NO: 27823 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctgttgctcaaatttcacctattgaaattgcttctcagctcccaacaactgatgcaccagttatgttggaccgaatgttgcgtctcttggcctgtcacaatatcctcccttgttcagttcgtactcaacaagatggaaaggttcagagactttatggtttggctactgttgctaa

SEQ ID NO: 27824 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctgttgctcaaatttcacctattgaaattgcttctcagctaccaactgatgcaccagttatgttggaccgaatgttgcgtctcttggcttgttacaatatcctcacttgttcagttcgtactcaactagatggaaaggttcagagactttatggtttggctactgttgataa

SEQ ID NO: 27825 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctgttgctcaaatttcacctattgaaattgcttctcagctaccaacaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27826 - DNA, 333 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctgtgctcaaatttcacctattgaaattgcttctcagctaccaccgaatgttgcgtctcttggcttgttacaatatcctcacttgttcagttcgtactcaacaagatggaaaggttcagagactttatggtttggctactgttgctaa

SEQ ID NO: 27827 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggttctgaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27828 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggttctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27829 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggttctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27830 - DNA, 369 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggttctcaaatttcacctattgaaattgcttctcagctaccaacaactaaccaaccctgatgcaccagttatgttggaccgaatgttgcgtctcttggcttgttacaatatcctcacttgttcagttcttactcaacaagatggaaaagttcagagactttatggtttgctactgttgctaa

SEQ ID NO: 27831 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggttctcaaatttcacctattgaaattgcttctcagctaccaacaaccctgatgcaccagttatgttgttccgaatttttcctctcttgtcttgttacaatatcctcccttgttcagttcgtactcaacaatatggaaagtttcagagactttatggtttgtctactgttgctaa

SEQ ID NO: 27832 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgttcaaatttcgcctattgaaattgcttctcagctaccaacaagcaccagttatgttggaccgaatgttgcgtctcttggcttgttacaatatcctcacttgttcagttcgtactcaacaagatggaaaggttcagagactttatggtttggctactgttgctaa

SEQ ID NO: 27833 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgttcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttactaa

SEQ ID NO: 27834 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgttcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27835 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgttcaaatttcacctattgaaattgcttctcagctaccaacaactgcaccagttatgttggaccgaatgttgcgtctcttggcttgttacaatatcctcacttgttcagttcgtactcaacaagatggaaaggttcagagactttatggtttggctactgttgctaa

SEQ ID NO: 27836 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgttcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27837 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgttcaaatttcacctattgaaattgcttctcagctaccaacaactgatgcaccagttatgttggaccgaatgttgcgactcttggcttgttacaatatcctcacttgttcagttcgtactcaacaagatggaaaggttcagagactttatggtttggctactgttgctaa

SEQ ID NO: 27838 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgttcaaatttcacctattgaaattgcttctcagctaccaacaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27839 - DNA, 317 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27840 - DNA, 317 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgtgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27841 - DNA, 317 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgtgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27842 - DNA, 316 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgtgatgcaccagttatgttggaccgaatgttgcgtctcttggcttgttacaatatcctcacttgttcagttcgtactcaacaagatggaaaagttcagagactttatggtttggctatgttgctaa

SEQ ID NO: 27843 - DNA, 317 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27844 - DNA, 317 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgtgatgcaccagttatgttggaccgaatgttgcgtctcttggcttgttacaatatcctcacttgtttagttcgtactcaacaagatggaaaagttcagagactttatggtttggctactgttgctaa

SEQ ID NO: 27845 - DNA, 317 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgtgatgcaccagttatgttggaccgaatgttgcgtctcttggcttgttacaatatcctcacttgttcagttcgtactcaacaagatgtaaaggttcagagactttatggtttggctactgttgctaa

SEQ ID NO: 27846 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgtgatgcaccagttatgttggaccgaatgttgcgtctcttggcttgttacaatatcctcacttgttcagttcgtactcaacaagatggaaaagttcagagactttatggtttggctactgtttaa

SEQ ID NO: 27847 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcttaaatttctcctattgaatctgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27848 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcttaaatttcacctattgaaattgcttctcagctaccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 27849 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcttaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27850 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcttaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctag

SEQ ID NO: 27851 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcttaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27852 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctgaaatttcacctattgaaattgcttctcagctaccaacaactcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27853 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctctaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27854 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcgaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27855 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcgaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27856 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcgaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27857 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcgaatttcacctattgaaattgctcctcatgcaccagttatgttggaccgaatgttgcgtctcttggcttgttacaatatcctcacttgttcagttcgtactcaacaagatggaaagattcagagactttatggtttggctactgttgctaa

SEQ ID NO: 27858 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27859 - DNA, 320 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 27860 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27861 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27862 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 27863 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctccaatttcacctattgaaattgcttctcagctaccaacaaagggtttacacacgcgcacatcgttgcgttaagccaacacccggcagcgttagggaccgtcgctgtcaagtatcaggacatgatcgcagcgttgccagaggcgacacctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 27864 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcatatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 27865 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcatatttcacctattgaaattgcttctcagctaccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 27866 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcagatttcacctattgaaattgcttctcagctaccaacctgatgcaccagttatgttggaccgaatgttgcgtctcttggcttgttacaatatcctcacttgttaagttcgtaatcaacaagatggaaaggttcagagactttatggtttgctactgttgctaa

SEQ ID NO: 27867 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcagatttcacctattgaaattgcttctcagctaccaacctgatgcaccagttatgttggaccgaatgttgcgtctcttggcttgttacaatatcctcacttgttaagttcgtactcaacaagatggaaaggttcagagactttatggtttgctactgttgctaa

SEQ ID NO: 27868 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcagatttcacctattgaaattgcttctcagctaccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27869 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaccagttatgttggaccgaatgttgcgtctcttggcttgttacaatatcctcacttgttcggttcgtactcaacaagatggaaaggttccgagactttatggtttggctactgttgctaa

SEQ ID NO: 27870 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaccagttatgttggaccgaatgttgcgtctcttggcttgttacaatatcctcacttgttcagttcgtactcaacaagatggaaaggttcagagactttatggtttggctactgttgctaa

SEQ ID NO: 27871 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaccagttatgttggaccgaatgttgcgtctcttggcttgttacaatatcctcacttgttcagttcgtactcaacaagatggaaagattcagagactttatggtttggctactgttgctaa

SEQ ID NO: 27872 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaccagttatgttggaccgaatgttgcgtctcttggcttgttacaatatcctcacttgttcagttcgtactcaacaagatggaaaagttcagagactttatggtttggctactgttgctaa

SEQ ID NO: 27873 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaccagttatgttggaccgaatgttgcgtctcttggcttgttacaatatcctcacttgttcagttcgtactcaacaagatggaaaggttcagagactttatggtttagctactgttgctaa

SEQ ID NO: 27874 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaccagttatgttggaccgaatgttgcgtctcttggcttgttacaatatcctcacttgctcagttcgtactcaacaagatggaaagattcagagactttatggtttggctactgttgctaa

SEQ ID NO: 27875 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcacatttcacctattgaaattgcttctcagctaccaacaactgatgcaccagttatgttggaccgaatgttgcgtctctctgcttgttaccatatcctcacttgttcagttcctacacaacaagatggaaaagttcagagactttattgtttgcctactgttgctaa

SEQ ID NO: 27876 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaatatgttggaccgaatgttgcgtctcttggcttgttacaatatcctcacttgttcagttcgtactcaacaagatggaaaggttcagagactttatggtttggctactgttgctaa

SEQ ID NO: 27877 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaatatgttggaccgaatgttgcgtctcttggcttgttacaatatcctcacttgttcagttcgtactcaacaagatggaaagattcagagactttatggtttggctactgttgctaa

SEQ ID NO: 27878 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaatatgttggaccgaatgttgcgtctcttggcttgttacaatatcctcacttgttcagttcgtactcaacaagatggaaaagttcagagactttatggtttggctactgttgctaa

SEQ ID NO: 27879 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaatatgttggaccgaacgttgcgtctcttggcttgttacaatatcctcacttgttcagttcgtactcaacaagatggaaagattcagagactttatggtttggctactgttgctaa

SEQ ID NO: 27880 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaagtttcacctattgaaattgcttctcagctaccaacaacttatgttggaccgaatgttgcgtctcttggcttgttacaatatcctcacttgttctgttcgtactcaacaagatggaaaggttcagagactttatggtttggctactgttgctaa

SEQ ID NO: 27881 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaattttacctattgaaattgcttctcagctcccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27882 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaattttacctattgaaattgcttctcagctaccaaccctgatgcaccagttatgttggaccgaatgttgcgtctcttggcttgttacaatatcctcacttgttcagttcgtactcaacaatatggaaaggttcagagactttatggtttggctactgttgctaa

SEQ ID NO: 27883 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaattttacctattgaaattgcttctcagctaccaacactgatgcaccagttatgttggaccgaatgttgcgtctcttggattgttacaatatcctcacttgttcagttcgtactcaacaagatggaaaggttcagagcctttatggtttggctactgttgctaa

SEQ ID NO: 27884 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattgaaattgcttctcagctcccaacaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27885 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattgaaattgcttctcagctaccctgatgcaccagttatgttggaccgaatgttgcgtctcttggcttgttacaatatcctcacttgttcagttcgtactcaacaagatggaaaggtttagagactttatggtttggctactgttgctaa

SEQ ID NO: 27886 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27887 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattgaaattgcttctcagctaccaacactgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 27888 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattgaaattgcttctcagctaccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 27889 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27890 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27891 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattgaaattgcttctcagctaccaacaactaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 27892 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattgaaattgcttctcagctaccaacaacctgatgcaccagttatgttggaccgaatgttgcgtctcttggcttgttacaatatcctcacttgttcagttcgtactcaacaatatggaaagattcagagactttatggtttggctactgttgctaa

SEQ ID NO: 27893 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattcaaattgcttctcagctcccaaccactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 27894 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctcccaacgatgcaccagttatgttggaccgaatgttgcgtctcttggcttgttacaatatcctcactttttcagttcgtactcaacaagatggaaagattcagagactttatggtttggctactgttgctaa

SEQ ID NO: 27895 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctcccaacaccagttatgttggaccgaatgttgcgtctcttggcttgttacaatatcctcacttgttcagttcgtactcaacaagatggaaagattcagagactttatggtttggctactgttgctaa

SEQ ID NO: 27896 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27897 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27898 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgataa

SEQ ID NO: 27899 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctaccaccgaatgttgcgtctcttggcttgtttcaatatcctcacttgttcagttcgtactcaacaagatggaaaggttcagagactttatggtttggctactggtgctaa

SEQ ID NO: 27900 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctaccaacaattatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27901 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27902 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27903 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27904 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctaccaacaacctgatgcaccagttatgttggaccgaaagttgcatctcttggcttgttacaatatcctcacttgttcagttcgtactcaacaagatggaaaggttcagagactttatggtttggctactgttgctaa

SEQ ID NO: 27905 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27906 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27907 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctaccaacaacaccagttatgttggaccgaatgttgcgtctcttggcttgttacaatatcctcacttgttcagttcgtactcaacaagatggaaaggttcagagactttatggtttggctactgttgctaa

SEQ ID NO: 27908 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcccctgttcaaattgcttctcagcttccaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27909 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcccctattgaaattgcttctcagctcccaactgatgcaccatttatgttggaccgaatgttgcgtctcttggcttgttacaatatcctcacttgttcagttcgtactcaacaagatggaaaggttcagagactttatggtttggctactgttgctaa

SEQ ID NO: 27910 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcccctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27911 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcatctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27912 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcagctattgaaattgcttctcagctaccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27913 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcagctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27914 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacttattgaaattgcttctcagctaccaacaatgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 27915 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacttattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27916 - DNA, 313 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcactgtcaccgaatgttgcgtctcttggcttgttacaatatcctcacttgttctgttcgtactcaacaagatggaaaggttcagagactttatggtttggctactgttgctaa

SEQ ID NO: 27917 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27918 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27919 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27920 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27921 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcaccttttgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27922 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcaccttttgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27923 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttgaaattgcttctcagctaccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 27924 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcttggcttgttacaatatcctcacttgttctgttcgtactcaacaagatggaaaggttcagagactttatggtttggctactgttgctaa

SEQ ID NO: 27925 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcttggcttgttacaatatcctcacttgttcggttcgtactcaacaagatggaaaggttcagagactttatggtttggctactgttgctaa

SEQ ID NO: 27926 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcttggcttgttacaatatcctcacttgttcagttcgtactcaacaagatggaaaggttcagagactttatggtttggctactgttgctaa

SEQ ID NO: 27927 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctttgttggaccgaatgttgcgtctcttggcttgttacaatatcctcacttgttctgttcgtactcaacaagatggaaaggttcagagactttatggtttggctactgttgctaa

SEQ ID NO: 27928 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctttcaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27929 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaatgcaccagtcatgttggaccgaatgttgcgtctcttggcttgttacaatatcctcacttgttcagttcgtactcaacaagatggaaagattcagagactttatggtttggctactgttgctaa

SEQ ID NO: 27930 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27931 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 27932 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27933 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaactgatgcaccagtcatgttggaccgaatgttgtgtctcttggcttgttacaatatcctcacttgttcagttcgtactcaacaagatggaaaagttcagagactttatggtttggctactgttgctaa

SEQ ID NO: 27934 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaactgatgcaccagtcatgttggaccgaatgttgcgtctcttggcttgttacaatatcctcacttgttctgttcgtactcaacaagatggaaaggttcagagactttatggtttggctactgttgcgaa

SEQ ID NO: 27935 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27936 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27937 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 27938 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27939 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27940 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaactctgatgcaccagttatgttggaccgaatgttgcgtctcttggcttgttacaatatcctcacttgttcagttcgtactcaacaggatggaaagattcagagactttatggtttggctactgttgctaa

SEQ ID NO: 27941 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27942 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27943 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacatgcatcagtcatgttggaccgaatgttgcgtctcttggcttgttacaatatcctcacttgttctgttcgtactcaacaagatggaaaggttcagagactttatggtttggctactgttgctaa

SEQ ID NO: 27944 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27945 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttcagttcgtactcaacaagatggaaagattcagagactttatggtttggctactgttgctaa

SEQ ID NO: 27946 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27947 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27948 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacatcagtcatgttggaccgaatgttgcgtctcttggcttgttacaatatcctcacttgttctgttcgtactcaacaagatggaaagattcagagactttatggtttggctactgttgctaa

SEQ ID NO: 27949 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacagcctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27950 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 27951 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27952 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27953 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 27954 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27955 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27956 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 27957 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcggagactttatggtttggctactgttgctaa

SEQ ID NO: 27958 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27959 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacacctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 27960 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27961 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 27962 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaccagttatgttggaccgaatgttgcgtctcttggcttgttacaatatcctcacttgttcagttcgtactcaacaagatggaaagattcagagactttatggtttggctactgttgctaa

SEQ ID NO: 27963 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27964 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaatgcaccagtcatgttggaccgaatgttgcgtctcttggcttgttacaatatcctcacttgttctgttcgtactcaacaagacggaaaggttcagagactttatggtttggctactgttgctaa

SEQ ID NO: 27965 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaatgcaccagtcatgttggaccgaatgttgcgtctcttgacttgttacaatatcctcacttgttctgttcgtactcaacaagatggaaaggttcagagactttatggtttggctactgttgctaa

SEQ ID NO: 27966 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27967 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaatgcaccagtcatgttggaccgaatgttgcgtctcttggcttgttacaatatcctcacttgttcagttcgtactcaacaagatggaaagattcagagactttatggtttggctactgttgctaa

SEQ ID NO: 27968 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaatatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27969 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaatatgcaccagtcatgttggaccgaatgttgcgtctcttggcttgttacaatatcctcacttgttcagttcgtactcaacaagatggaaagattcagagactttatggtttggctactgttgctaa

SEQ ID NO: 27970 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacttatcccctgattctgtggataaccgtattaccgcctttgagtgagccctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 27971 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacttatcccctgattctgtggataaccgtattaccgcctttgagtgagccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27972 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactgccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27973 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27974 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactgatgcaccagttatgttggaccgaatgttgcgtctctgggcttgttacaatatcctcacttgttcagttcgtactcaacaagatggaaaggttcagagactttatggtttggctactgttgctaa

SEQ ID NO: 27975 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactgatgcaccagttatgttggaccgaatgttgcgtctcttggcttgttacaatatcctcacttgttcagttcgtactcaacaagatggaaaagttcagagactttatggtttggctactgttgctag

SEQ ID NO: 27976 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27977 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27978 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 27979 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27980 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 27981 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27982 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactctgatgcaccagtcatgttggaccgaatgttgcgtctcttggcttgttacaatatcctcacttgttctgttcgttctcaacaagatggaaaagttcagagactttatggtttggctactgttgctaa

SEQ ID NO: 27983 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27984 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaggcgctggagacggtgcaggcgctgttgccggtgctgtgccaggcccacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27985 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaggcgctggagacggtgcaggcgctgttgccggtgctgtgccaggcccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27986 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27987 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27988 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 27989 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaccagtcatgttggaccgaatgttgcgtctcttggcttgttacaatatcctcacttgttctgttcgtactcaacaagatggaaaggttcagagactttatggtttggctactgttgctaa

SEQ ID NO: 27990 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaccagtcatgttggaccgaatgttgcgtctcttggcttgttacaatatcctcacttgttcagttcgtactcaacaagatggaaaagttcagagactttatggtttggctactgttgctaa

SEQ ID NO: 27991 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaccagtcatgttggaccgaatgttgcgtctcttggcttgttacaatatcctcacttgttctgttcgtactcaacaagatggaaaggttcagagcctttatggtttggctactgttgctaa

SEQ ID NO: 27992 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaccagtcatgttggaccgaatgttgcgtctcttggcttgttacaatatcctcacttgttcagttcgtactcaacaagatggaaaggttcagagactttatggtttggctactgttgctaa

SEQ ID NO: 27993 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 27994 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaatgcaccagttatgttggaccgaatgttgcgtctcttggcttgttacaatatcctcacttgttcagttcgtactcaacaagatggaaagatgcagagactttatggtttgtactgttgctaa

SEQ ID NO: 27995 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaatgcaccagtcatgttggaccgaatgttgcgtctcttggcttgttacaatatcctcacttgttcagttcgtactcaacaagatggaaagattcagagactttatggtttggctactgttgctaa

SEQ ID NO: 27996 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 27997 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 27998 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 27999 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactaacccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28000 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacgtactcaacaagatggaaaggttcagagactttatggtttggctactgttgctaa

SEQ ID NO: 28001 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28002 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28003 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28004 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 28005 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccaaatgttgcgtctcttggcttgttacaatatcctcacttgttctgttcgtactcaacaagatggaaaggttcagagactttatggtttggctactgttgctaa

SEQ ID NO: 28006 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 28007 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28008 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 28009 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 28010 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 28011 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatgggttggcgactgttgctaa

SEQ ID NO: 28012 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagtcatgttggaccggatgttgcgtctcttggcttgttacaatatcctcacttgttcagttcgtactcaacaagatggaaagattcagagactttatggtttggctactgttgctaa

SEQ ID NO: 28013 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaaccagtcatgttggaccgaatgttgcgtctcttggcttgttacaatatcctcacttgttctgttcgtactcaacaagatggaaaggttcagagactttatggtttggctactgttgctaa

SEQ ID NO: 28014 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaaccagtcatgttggaccgaatgttgcgtctcttggcttgttacaatatcctcacttgttcagttcgtactcaacaagatggaaaggttcagagactttatggtttggctactgttgctaa

SEQ ID NO: 28015 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28016 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 28017 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 28018 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctgatgcaccagtcatgttggaccgaatgttgcgtctcttggcgtgttacaatatcctcacttgttcagttcgtactcaacaagatggaaaggttcagagactttatggtttggctactgttgctaa

SEQ ID NO: 28019 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 28020 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaagttatgttggaccgaatgttgcgtctcttggcttgttacaatatcctcacttgttcagttcgtactcaacaagatggaaaggttcagagactttatggtttggctactgttgctaa

SEQ ID NO: 28021 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaactagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28022 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacgccatcgtggctggcgatggcccccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28023 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28024 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacatgatgcaccagttatgttggaccgaatgttgcgtctcttggcttgttacaatatcctcacttgttctgttcgtactcaacaagatggaaagattcagagactttatggtttggctactgttgctaa

SEQ ID NO: 28025 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28026 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaacttgcgtctcttggcttgttacaatatcctcacttgttcagttcgtactcaacaagatggaaaggttcagagactttatggtttggctactgttgctaa

SEQ ID NO: 28027 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28028 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactgatgcaccagttatgttggaccgaatgttgcgtctcttggcttgttacaatatcctcacttgttcggttcgtactcaacaagatggaaagattcagagactttatggtttggctactgttgctaa

SEQ ID NO: 28029 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28030 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactagccacgatggcggcaagcaggcgctggagacggtccagcggctgttctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28031 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaccgaatgttgcgtctcttggcttgttacaatatcctcacttgttcagttcgtactcaacaagatggaaaggttcagagactttatggtttggctactgttgctaa

SEQ ID NO: 28032 - DNA, 397 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaggcgcagcggtcgggctgaacggggggttaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28033 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28034 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccagttatgttggaccgaatgttgcgtctcttggcttgttacaatatcctcacttgttcagttcgtactcaacaagatggaaaagttcagagactttatggtttggctactgttgctaa

SEQ ID NO: 28035 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaactaaccagttatgttggaccgaatgttgcgtctcttggcttgttacaatatcctcacttgttcagttcgtactcaacaagatggaaaggttcagagactttatggtttggctactgttgctaa

SEQ ID NO: 28036 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaacctgatgcgccagttatgttggaccgaatgttgcgtctcttggcttgttacaatatcctcacttgttctgttcgtactcaacaagatggaaaggttcagagactttatggtttggctactgttgctaa

SEQ ID NO: 28037 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28038 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28039 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28040 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28041 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28042 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28043 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacactgatgcaccagttatgttggacccaatgttgcgtctcttggcttgttacaatatcctcacttgttcagttcgtactcaacaagatggaaaggttcagagactttatggtttggctactgttgctaa

SEQ ID NO: 28044 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28045 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaccagttatgttggaccgaatgttgcgtctcttggcttgttacaatatcctcacttgttcagttcgtactcaacaagatggaaaagttcagagactttatggtttggctactgttgctaa

SEQ ID NO: 28046 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28047 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28048 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactttatgttggaccgaatgttgcgtctcttggcttgttacaatatcctcacttgttcagttcgtactcaacaagatggaaaggttcagagactttatggtttggctactgttgctaa

SEQ ID NO: 28049 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaacttgcaccagttatgttggaccgaatgttgcgtctcttggcttgttacaatatcctcacttgttcagttcgtactcaacaagatggaaaggttcagagactttatggtttggctactgttgctaa

SEQ ID NO: 28050 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28051 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28052 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28053 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28054 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaccctgatgcaccagttatgttggaccgaatgttgcggctcttggcttgttacaatatcctcacgtgttcagttcgtactcaacaagatggaaaggttcagaggctgtatggtttggctactgttgctaa

SEQ ID NO: 28055 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaactccagcgcctgcttgccgccatcgtggccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28056 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28057 - DNA, 428 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaaccgaacaggcttatgtccactgggttcgtgtggtggccatcgccagccacgatggcggcaagcactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28058 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactaacccgtgggcctggcacagcaccggcaacagcgccctgatgctccagttatgttggaccgaatgttgcgtctcttcgcttgttacaatatcctcacttgttcagttcgtactcaacaagatggaaagattcagagactttatggtttggctactgttgctaa

SEQ ID NO: 28059 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28060 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28061 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28062 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaacctgatgcaccagttatgttggaccgaatgttgcgtctcttggcttgttacaatatcctcacttgttcagttcgtactcaacaagatggaaaggttcagagacttcatggtttggctactgttgctaa

SEQ ID NO: 28063 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28064 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaaccctgatgcaccagttatgttggaccgaatgttgcgtctcttggcttgttacaatatcctcacttgttcagttcgtactaaacaagatggaaaagttcagagactttatggtttggctactgttgctaa

SEQ ID NO: 28065 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28066 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaaccaccagttatgttggaccgaatgttgcgtctcttggcttgttacaatatcctcacttgttcagttcgtactcaacaagatggaaagattcagagactttatggtttggctactgttgctaa

SEQ ID NO: 28067 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctag

SEQ ID NO: 28068 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaacaccagttatgttggaccgaatgttgcgtctcttggcttgttacaatatcctcacttgttcagttcgtactcaacaagatggaaaggttcagagactttatggtttggctactgttgctaa

SEQ ID NO: 28069 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28070 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcgtccaacactgatgcaccagtcatgttggaccgaatgttgcgtctcttggcttgttacaatatcctcacttgttcagtttgtactcaacaagatggaaagattcagagactttatggtttggctactgttgctaa

SEQ ID NO: 28071 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcctccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28072 - DNA, 270 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcaacaagatggaaaagttcagagactttatggtttggctactgttgctaa

SEQ ID NO: 28073 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcgtctcttggcttgttacaatatcctcacttgttctgttcgtactcaacaagatggaaaggttcagagactttatggtttggctactgttgctaa

SEQ ID NO: 28074 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcgtctcttggcttgttacaatatcctcacttgttctgttcgtactcaacaagatggaaagattcagagactttatggtttggctactgttgctaa

SEQ ID NO: 28075 - DNA, 309 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcgtctcttggcttgttacaatatcctcacttgttctgttcgtactcaacaagatggaaaggttcagagactttatggtttggctactgttgcaa

SEQ ID NO: 28076 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcgtctcttggcttgttacaatatcctcacttgttcagttcgtactcaacaagatggaaagattcagagactttatggtttggctactgttgctaa

SEQ ID NO: 28077 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcgtctcttggcttgttacaatatcctcacttgttcagttcgtactcaacaagatggaaaagttcagagactttatggtttggctactgttgctaa

SEQ ID NO: 28078 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcctctcagctcccaacaactgatgcaccagttatgttggaccgaatgttgcgtctcttggcttgctacaatagccacacttgttcagttcgtactcaaaaagatggaaaagttcagagaatttatggtttggctactgttgctaa

SEQ ID NO: 28079 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcaccagttatgttggaccgaatgttgcgtctcttggcttgttacaatatcctcacttgttcagttcgtactcaacaagatggaaaggttcagagactttatggtttggctactgttgctaa

SEQ ID NO: 28080 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28081 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatttaaattgcttctcagctaccaacaactgatgcaccagttatgttggaccgaatgttgcgtctcttggcttgttacaatatcctcacttgttcaggtcgtactcaacaagatggaaaagttcagatactttatggtttggctactgttgctaa

SEQ ID NO: 28082 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatttaaattgcttctcagctaccaacaacatgcaccagttatgttggaccgaatgttgcgtctcttggcttgttacaatatcctcacttgttcagttcgtacccaacaagatggaaaagttcagagactttatggtttggctactgttgctaa

SEQ ID NO: 28083 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgtaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28084 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgtaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28085 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattggaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28086 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgatattgcttctcagctcccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28087 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgatattgcttctcagctaccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28088 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgagattgcttctcagctaccaacaacttatcttcgagccagccacgatcgacattgatctgtgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28089 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgagattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28090 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgagattgcttcgcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28091 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgacttgttacaatatcctcacttgttcagttcgtactcaacaagatggaaaggttcagagactttatgggttggctactgttgctaa

SEQ ID NO: 28092 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgacttgttacaatatcctcacttgttcagttcgtactcaacaagatggaaaggttcagagactttatggtttggctactgttgctaa

SEQ ID NO: 28093 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgacttgttacaatatcctcacttgttcagttcgtactcaacaagatggaaaagttcagagactttatggtttggctactgttgctaa

SEQ ID NO: 28094 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgacttgttacaatatcctcacttgttcagttcgtactcaacaagatgtaaaggttcagagactttatggtttggctactgttgctaa

SEQ ID NO: 28095 - DNA, 293 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgacttgttacaatatcctcacttgttcagttcgtactcaacaagatggaaaggttcagagactttatggtttggctactgtttaa

SEQ ID NO: 28096 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgacttgttacaatatcctcacttgttcagttcgtactcaacaagatggaaagattcagagactttatggtttggctactgttgctaa

SEQ ID NO: 28097 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgacttgttacaatatcctcacttgttcagttcgtactcaacaagatggaaaggttcagagactgtatggtttggcgactgttgctaa

SEQ ID NO: 28098 - DNA, 337 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28099 - DNA, 337 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28100 - DNA, 337 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgactgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 28101 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgacattgcttctcagctcccaacagttggaccgaatgttgcgtctcttggcttgttacaatatcctcacttgttcagttcgtactcaacaagatggaaaggttcagagactttatggtttggctactgttgctaa

SEQ ID NO: 28102 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgacattgcttctcagctcccaacaacctgatgcaccagttatgttggaccgaatgttgcgtctcttggcttgttacaatttcctcgcttgttctgttcgttctcaacaagatggaaaggtttagagactgtatggtttggctactgttgctaa

SEQ ID NO: 28103 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaatttgcttcgcagctaccaacaacctgatgcaccagttatgttggaccgaatgttgcgtctattggcttgttacaatatcctcactttttcatttcgttcccaacaagatggaaaatttcagagactgtatggtttggctactgttgctaa

SEQ ID NO: 28104 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28105 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28106 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaatgcaccagttatgttggaccgaatgttgcgtctcttggcttgttacaatatcctcacttgttcagttcgtactcaacaagatggaaagattcagagactttatggtttggctactgttgctaa

SEQ ID NO: 28107 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatttcaccagttatgttggaccgaatgttgcgtctcttggcttgttacaatatcctcacttgttcagttcgtactcaacaagatggaaaggttcagagactttatggtttggctactgttgctaa

SEQ ID NO: 28108 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatttcaccagttatgttggaccgaatgttgcgtctcttggcttgttacaatatcctcacttgttcagttcgtactcaacaagatggaaagattcagagactttatggtttggctactgttgctaa

SEQ ID NO: 28109 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctcccaacaactgatgcaccagttatgttggaccgaatgttgcgtctcttggcttgttacaatatcctcacttgttcagttcgtactcaacaagatggaaaggttcagagactttatggtttggctaatgttgctaa

SEQ ID NO: 28110 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28111 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctaccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28112 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28113 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28114 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgtttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28115 - DNA, 296 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgttacaatatcctcacttgttcagttcgtactcaacaagatggaaaggttcagagactttatggtttggctactgttgctaa

SEQ ID NO: 28116 - DNA, 296 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgttacaatatcctcacttgttcagttcgtactcaacaagatggaaaagttcagagactttatggtttggctactgttgctaa

SEQ ID NO: 28117 - DNA, 296 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgttacaatatcctcacttgttcagttcgtactcaacaagatggaaagattcagagactttatggtttggctactgttgctaa

SEQ ID NO: 28118 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgttacaatatcctcacttgttcagttcgtactcaacaagatggaaagattcagagactttatggtttggctactgttgcta

SEQ ID NO: 28119 - DNA, 292 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgttacaatatcctcacttgttcagttcgtactcaacaagatggaaaagttcagagactttatggtttggctactgttg

SEQ ID NO: 28120 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattggttctcagctaccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28121 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttgtcagctcccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28122 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttgcaccagttatgttggaccgaatgttgcgtctcttggcttgttacaatatcctcacttgttcagttcgtactcaacaagatggaaaagttcagagactttatggtttggctactgttgctaa

SEQ ID NO: 28123 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttgcaccagttatgttggaccgaatgttgcgtctcttggcttgttacaatatcctcacttgttcagttcgtactcaacaagatggaaaggttcagagactttatggtttggctactgttgctaa

SEQ ID NO: 28124 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttgcaccagttatgttggaccgaatgttgcgtctcttggcttgttacaatatcctcacttgttcagttcgtactcaacaagatggaaagattcagagactttatggtttggctactgttgctaa

SEQ ID NO: 28125 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttgcaccagttatgttggaccgaatgttgcgtctcttggcttgttacaatatcctcacttgttctgttcgtactcaacaagatggaaaggttcagagactttatggtttggctactgttgctaa

SEQ ID NO: 28126 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttcttggaccgaatgttgcgtctcttggcttgttacaatatcctcacttgttcagttcgtactcaacaagatggaaaggttcagagactttatggtttggctactgttgctaa

SEQ ID NO: 28127 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttcttggaccgaatgttgcgtctcttggcttgttacaatatcctcacttgttctgttcgtactcaacaagatggaaaggttcagagactttatggtttggctactgttgctaa

SEQ ID NO: 28128 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcttggcttgttacaatatcctcacttgttctgttcgtactcaacaagatggaaaggttcagagactttatggtttggctactgttgctaa

SEQ ID NO: 28129 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctctgctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28130 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctcccaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28131 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28132 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctcccaacaactcaccagttatgttggaccgaatgttgcgtctcttggcttgttacaatatcctcacttgttcagttcgtactcaacaagatggaaaggttcagagactttatggtttggctactgttgctaa

SEQ ID NO: 28133 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctcccaacaaccacctgctccggggtcaagccgtgggcctggcacagcaccggcaacagccgctggaccgtctccagcgcctctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28134 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctaccatgcaccagttatgttggaccgaatgttgcgtctcttggcttgttacaatatcctcacttgttcagttcgtactcaacaagatggaaagattcagagactttatggtttggctactgttgctaa

SEQ ID NO: 28135 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcggctaccaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28136 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28137 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28138 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcatgcaccagttatgttggaccgaatgttgcgtctcttggcttgttacaatatcctcacttgttcagttcgtactcaacaagatggaaagattcagagactttatggtttggctactgttgctaa

SEQ ID NO: 28139 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcatctcccaacaactaaccgtcaacagccgctggaccgtctccagcgccctgatgcaccagttatgttggaccgaatgttgcgtctcttggcttgttacaatatcctcacttgttcagttcgtactcaacaagatggaaaggttcagagactttaagggttggctactgatgctaa

SEQ ID NO: 28140 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcatctcccaacaaccagttatgttggaccgaatgttgcgtctcttggcttgttacaatatcctcacttgttcagttcgtactcaacaagatggaaaagttcagagactttatggtttggctactgttgctaa

SEQ ID NO: 28141 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcatctaccaacaacctgatgcaccagttatgttggaccgaatgtttcgtctctttgcttgttacaatatcctcactttttcatttcgtactcaacaagatggaaattttcagatactttatggtttggctactgttgctaa

SEQ ID NO: 28142 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagttaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28143 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaggtaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28144 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaggtaccaacaactccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28145 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaggatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28146 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaggatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28147 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaggatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28148 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaggatgcaccagttatgttggaccgaatgttgcgtctcttggcttgttacaatatcctcacttgttcagttcgtactcaacaagatggaaaggttcagagactttatggtttggctactgttgcta

SEQ ID NO: 28149 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctttcgccaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28150 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttgcaccagttatgttggaccgaatgttgcgtctcttggcttgttacaatatcctcacttgttcagttcgtactcaacaagatggaaagattcagagactttatggtttggctactgttgctaa

SEQ ID NO: 28151 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28152 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28153 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28154 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28155 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28156 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28157 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28158 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacatgcaccagtcatgttggaccgaatgttgcgtctcttggcttgttacaatatcctcacttgttctgttcgtactcaacaagatggaaagattcagagactttatggtttggctactgttgctaa

SEQ ID NO: 28159 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacactgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 28160 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 28161 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 28162 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaatatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 28163 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 28164 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactgatgcaccagtcatgttggaccgaatgttgcgtctcttggcttgttacaatatcctcacttgtgcagttcgtactcaacaagatggaaaggttcagagactttatggtttggctacgttgctaa

SEQ ID NO: 28165 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 28166 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 28167 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28168 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaactaatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 28169 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaacctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 28170 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 28171 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 28172 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28173 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28174 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28175 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaaccagtcatgttggaccgaatgttgcgtctcttggcttgttacaatatcctcacttgttctgttcgtactcaacaagatggaaaggttcagagactttatggtttggctactgttgctaa

SEQ ID NO: 28176 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28177 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacaaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 28178 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgccaacaactttatgttggaccgaatgttgcgtctcttggcttgttacaatatcctcacttgttcagttcgtactcaacaagatggaaagattcagagactttatggtttggctactgttgctaa

SEQ ID NO: 28179 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28180 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgtttccgctcttggcttggtacaatatcctcacttgttcagttcgtactcaacaagatggaaaagttcagagactttatggtttggctactgttgctaa

SEQ ID NO: 28181 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28182 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28183 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28184 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaagattcggagactttatggtttggctactgttgctaa

SEQ ID NO: 28185 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28186 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 28187 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgatgcaccagttatgttggaccgaatgtgccgcccctgggttggtacaatatcctcacttgttcagttcgtactcaacaagatggaaaggttcagagactttatggtttggctactgttgctaa

SEQ ID NO: 28188 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 28189 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28190 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28191 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28192 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28193 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28194 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 28195 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28196 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28197 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28198 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28199 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 28200 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 28201 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcctaacaactaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28202 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28203 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28204 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 28205 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28206 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccagcctgatgcaccagttatgttggaccgaatgttgcgtcgcttggctggttacaatatcctcacttgttcagttcgtactcaacaagatggaaaggttcagagactttatggtttggctactgttgctaa

SEQ ID NO: 28207 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccagccactcagccgcgggtttctggagtttaatgagctaagcacatacgtcagaaaccattattgcgcgttcaaaagtcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28208 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccagcaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28209 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28210 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28211 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28212 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28213 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccacctgatgcaccagttatgttggaccgaatgttgcgtgtcttggcttgttacaatatcctcacttgttcagttcgtactcaacaagatggaaagattcagagactttatggtttggctactgttgctaa

SEQ ID NO: 28214 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccacctgatgcaccagttatgttggaccgaatgttgcgtctcttggcttgttacaatatcctcacttgttcagttcgtactcaacaagatggaaagactcagagactttatggtttggctactgttgctaa

SEQ ID NO: 28215 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28216 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28217 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 28218 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaaaaagatggaaaggttcagagtctttatggtttggctactgttgctaa

SEQ ID NO: 28219 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcagcaagatggaaagattcagagactttatggtttggctactgttgctaa

SEQ ID NO: 28220 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28221 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttgcaatatcctcacttgttcagttcgtactcaacaagatggaaagattcagagactttatggtttggctactgttgctaa

SEQ ID NO: 28222 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagcctttatggtttggctactgttgctaa

SEQ ID NO: 28223 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgcaccagttatgttcgaccgaatgttgcgtctcttggcttgttacaatatcctcacttgttcagttcgtactcaacaagatggaaagattcagagactttatggtttggctactgttgctaa

SEQ ID NO: 28224 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28225 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28226 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28227 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 28228 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgcactcaacaagatggaaagattcagagactttatggtttggctactgttgctaa

SEQ ID NO: 28229 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28230 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttagggtttggctactgttgctaa

SEQ ID NO: 28231 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgatgcaccagttatgttggaccaaatgttgcgtctcttggcttgttacaatatcctcacttgttctgttcgtactcaacaagatggaaaggttcagagactttatggtttggctactgttgctaa

SEQ ID NO: 28232 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28233 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28234 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 28235 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatatgcaccagttatgttggaccgaatgttgcgtctcttggcttgttacaatatcctcacttgttcagttcgtactcaacaagatggaaagattcagagactttatggtttggctactgttgctag

SEQ ID NO: 28236 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaagttatgttggaccgaatgttgcgtctcttggcttgttacaatatcctcacttgttcagttcgtactcaacaagatggaaaggttcagagactttatggtttggctactgttgctaa

SEQ ID NO: 28237 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaagttatgttggaccgaatgttgcgtctcttggcttgttacaatatcctcacttgttcagttcgtactcaacaagatggaaagattcagagactttatggtttggctactgttgctaa

SEQ ID NO: 28238 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaggtgtacggctacaggggcaagctcctgggcggctccagatgcaccagttatgttggaccgaatgttgcgtctctgggcttgttacaatatccgcacttgttcagttcgtactcaacaagatggaaaggttcagagactttatggtttggctactgttgctaa

SEQ ID NO: 28239 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaggtgtacggctacaggggcaagcacctgggcggctccagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28240 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaggtgtacggctacaggggcaagcacctgggcggctccagatgtaccagttatgttggaccgaatgttgcgtctcttggcttgttacaatatcctcacttgttcagttcgtactcaacaagatggaaaggttcagagactttatggtttggctactgttgctaa

SEQ ID NO: 28241 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 28242 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28243 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaggttcagagactttatggtttggctatgttgctaa

SEQ ID NO: 28244 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaagattcagagactttatggtttggctactgtgctaa

SEQ ID NO: 28245 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28246 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28247 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaagattcagagactttatggtttggcgactgttgctaa

SEQ ID NO: 28248 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28249 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28250 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacttatgttggaccgaatgttgcgtctcttggcttgttacaatatcctcacttgttcagttcgtactcaacaagatggaaagattcagagactttatggtttggctactgttgctaa

SEQ ID NO: 28251 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacttatgttggaccgaatgttgcgtctcttggcttgttacaatatcctcacttgttctgttcgtactcaacaagatggaaaggttcagagactttatggtttggctactgttgctaa

SEQ ID NO: 28252 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacttatgttggaccgaatgttgcgtctcttggcttgttacaatatcctcacttgttcagttcgtactcaacaagatggaaaggttcagagactttatggtttggctactgttgctaa

SEQ ID NO: 28253 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacttatgttggaccgaatgttgcatctcttggcttgttacaatatcctcacttgttcagttcgtactcaacaagatggaaaggttcagagactttatggtttggctactgttgctaa

SEQ ID NO: 28254 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcatcagttatgttggaccgaatgttgcgtctcttggcttgttacaatatcctcacttgttcagttcgtactcaacaagatggaaaggttcagagactttatggtttggctactgttgctaa

SEQ ID NO: 28255 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttattttggaccgaatgttgcgtctcttggcttgttacaatatcctcacttgttcagttcgtactcaacaagatggaaatattccgacactttatggtttggctactcttgctaa

SEQ ID NO: 28256 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggcccgaatgttgcgtctcttggctggttacaataccctcccttgttcgtttcgtatccaacaagatgaaaaggttcagagccttatggtttggctactgttgctaa

SEQ ID NO: 28257 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28258 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28259 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28260 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28261 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtgctcaacaagatggaaaggttcagagactttatggtttggctactgttgctaa

SEQ ID NO: 28262 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 28263 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttgggtactgttgctaa

SEQ ID NO: 28264 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcgtcacttgttcagttcgtactcaacaagatggaaaggttcagagactttatggtttggctactgttgctaa

SEQ ID NO: 28265 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaggatggaaaggttcagagactttatggtttggctactgttgctaa

SEQ ID NO: 28266 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttaagttcgtactcaacaagatggaaaggttcagagactttatggtttggctactgttgcta

SEQ ID NO: 28267 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaaggtggaaagattcagagactttatggtttggctactgttgctaa

SEQ ID NO: 28268 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28269 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatgaaaaggttcagagactttatggtttggctactgttgctaa

SEQ ID NO: 28270 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctac

SEQ ID NO: 28271 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgtgacaatatcctcacttgttcagttcgtactcaacaagatggaaagattcagagactttatggtttggctactgttgctaa

SEQ ID NO: 28272 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgctggaccgaatgttgcgtctcttggcttgttacaatatcctcacttgttcagttcgtactcaacaagatggaaaggttcagagactttatggtttggctactgttgctaa

SEQ ID NO: 28273 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28274 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagtaatgttggaccgaatgttgcgtctcttggcttgttacaatatcctcacttgttcagttcgtactcaacaagatggaaaggttcagagcctttatggtttggctactgttgctaa

SEQ ID NO: 28275 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28276 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28277 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactagatgcaccagttatgttggaccgaatgttgcgtctcttggcttgttacaatatcctcacttgttcagttcgtactcaacaagatggaaagattcagagactttatggtttggctactgttgctaa

SEQ ID NO: 28278 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28279 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactactggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 28280 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28281 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28282 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacgccatcgtggctggcgatggccaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28283 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacgccatcgtggctggcgagggccaccctgatgcaccagttatgttggaccgaatgttgcgtctcttggcttgttacaatatcctcacttgtgcagttcgtactcaacaagatggaaagattcagagactttatggtttggcgactgttgctaa

SEQ ID NO: 28284 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttcagttcgtactcaacaagatggaaagattcagagactttatggtttggctactgttgctaa

SEQ ID NO: 28285 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 28286 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttcagttcgtactcaacaagatggaaaagttcagagactttatggtttggctactgttgctaa

SEQ ID NO: 28287 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacgatgcaccagttatgttggatcgaatgttgcgtctcttggcttgttacaatatcctcacttgttcagttcgtactcaacaagatggaaagattcagagactttatggtttggctactgttgctaa

SEQ ID NO: 28288 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28289 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28290 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28291 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28292 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaataagatggaaaagttcagagactttatggtttggctactgttgctaa

SEQ ID NO: 28293 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 28294 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28295 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28296 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagtttgtactcaacaagatggaaagattcagagactttatggtttggctactgttgctaa

SEQ ID NO: 28297 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 28298 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 28299 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28300 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgtttcgtctcttggcttgttacaatatcctcacttgttcagttcgtactaaacaagatggaaaggttcagagactttatggtttggctactgttgctaa

SEQ ID NO: 28301 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttgcaatatcctcacttgttcagttcgtactcaacaagatggaaaagttcagagactttatggtttggctactgttgctaa

SEQ ID NO: 28302 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggacctaatgttgcgtctcttggcttgttacaatatcctcacttgttcagttcgtactcaacaagatggaaaggttcagagactttatggtttggctactgttgctaa

SEQ ID NO: 28303 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28304 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28305 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28306 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28307 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggagaggttcagagactttatggtttggctactgttgctaa

SEQ ID NO: 28308 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttattcagttcgtactcaacaagatggaaaggttcagagactttatggtttggctactgttgctaa

SEQ ID NO: 28309 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatgtaaagattcagagactttatggtttggctactgttgctaa

SEQ ID NO: 28310 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaccagttatgttggaccgaatgttgcgtctcttggcttgttacaatatcctcacttgttcagttcgtactcaacaagatggaaagattcagagactttatggtttggctactgttgctaa

SEQ ID NO: 28311 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaccagttatgttggaccgaatgttgcgtctcttggcttgttacaatatcctcacttgttcagttcgtactcaacaagatggaaaggttcagagactttatggtttggctactgttgctaa

SEQ ID NO: 28312 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaccagttatgttggaccgaatgttgcgtctcttggcttgttacaatatcctcacttgttcagttcgtactcaacaagatggaaagattcagagactttatggtttgctacgttgctaa

SEQ ID NO: 28313 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatttatgttggaccgaatgttgcgtctcttggcttgttacaatatcctcacttgttcagttcgtactcaacaagatggaaaggttcagagactttatggtttggctactgttgctaa

SEQ ID NO: 28314 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgttggaccgaatgttgcgtctcttggcttgttacaatatcctcacttgttcagttcgtactcaacaagatggaaagattcagagactttatggtttggctactgttgctaa

SEQ ID NO: 28315 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgttggaccgaatgttgcgtctcttggcttgttacaatatcctcacttgttcagttcgtactcaacaagatggaaaggttcagagactttatggtttggctactgttgctaa

SEQ ID NO: 28316 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgttggaccgaatgttgcgtctcttggcttgttacaatatcctcacttgttcagttcgtactcaacaagatggaaagattcagagactttatggttggctactgttgctaa

SEQ ID NO: 28317 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgttggaccgaatgttgcgtctcttggcttgttacaatatcctcacttgttcagttcgtactcaacaagatggaaaagttcagagactttatggtttggctactgttgctaa

SEQ ID NO: 28318 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcccacttgttcagttcgtactcaacaagatggaaaggttcagagactttatggtttggctactgttgctaa

SEQ ID NO: 28319 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 28320 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28321 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28322 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagacggaaaggttcagagactttatggtttggctactgttgctaa

SEQ ID NO: 28323 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28324 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgtttcgtctcttggcttgttacaatatcctcacttgttcagttcgtactcaacaagatggaaagattcagagcctttatggtttggctactgttgctaa

SEQ ID NO: 28325 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctacttttgctaa

SEQ ID NO: 28326 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgttaa

SEQ ID NO: 28327 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttctgttcgtactcaacaagatggaaaggttcagagactttatggtttggctactggtgctaa

SEQ ID NO: 28328 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggctcgttacaatatcctcacttgttcagttcgtactcaacaagatggaaagattcagagactttatggtttggctactgttgctaa

SEQ ID NO: 28329 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28330 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28331 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 28332 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28333 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctctcttgttcagttcgtactcaacaagatggaaagattcagagactttatggtttggctactgttaa

SEQ ID NO: 28334 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcatctcttggcttgttacaatatcctcacttgttcagttcgtactcaacaagatggaaaggttcagagactttatggtttggctacctgttgctaa

SEQ ID NO: 28335 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28336 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28337 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 28338 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgatgcaccaattatgttggaccgaatgttgcgtctcttggcttgttacaatatcctcacttgttcagttcgtactcaacaagatggaaaggttcagagactttatggtttggctactgttgctaa

SEQ ID NO: 28339 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28340 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 28341 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28342 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28343 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatcctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 28344 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28345 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatcctgatgcaccagttatgttggaccgaatgttgcgtcgctgggcttgttaaaatatcctcacttgttcagttcgtactcaacaagatggaaacgttcagagactttatggtttggctactgttgctaa

SEQ ID NO: 28346 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28347 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatatgttggaccgaatgttgcgtctcttggcttgttacaatatcctcacttgttcagttcgtactcaacaagatggaaaggttcagagactttatggtttggctactgttgctaa

SEQ ID NO: 28348 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatatgttggaccgaatgttgcgtctcttggcttgttacaatatcctcacttgttctgttcgtactcaacaagatggaaaggttcagagactttatggtttggctactgttgctaa

SEQ ID NO: 28349 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28350 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28351 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagttggaccgaatgttgcgtctcttggcttgttacaatatcctcacttgttcagttcgtactcaacaagatggaaaggttcagagactttatggtttggctactgttgctaa

SEQ ID NO: 28352 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagttggaccgaatgttgcgtctcttggcttgttacaatatcctcacttgttcagttcgtactcaacaagatggaaagattcagagactttatggtttggctactgttgctaa

SEQ ID NO: 28353 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagttggaccgaatgtcgcgtctcttggcttgttacaatatcctcacttgttcagttcgtactcaacaagatggaaaggttcagagactttatggtttggctactgttgctaa

SEQ ID NO: 28354 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatggaaaggttcagagactttatggtttggctactgttgctaa

SEQ ID NO: 28355 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatggaaagattcagagactttatggtttggctactgttgctaa

SEQ ID NO: 28356 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatggaaaagttcagagactttatggtttggctactgttgctaa

SEQ ID NO: 28357 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatggaaaggttcagagcctttatggtttggctactgttgctaa

SEQ ID NO: 28358 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagttatgttggaccgaatgttgcgtctcttggcctgttacaatatcctcacttgttcagttcgtactcaacaagatggaaaggttcagagactttatggtttggctactgttgctaa

SEQ ID NO: 28359 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaggtggtggccatcgccagcaatggcggtggcaagcaggcgctggagacggtctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28360 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaggtggtggccatcgccagcaatggcggtggcaagcaggcgctggagacggtctctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28361 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaggtggtggccatcgccagcaataatggtggcaagcaggcgctggagacggtctctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28362 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagccagcaatggcggcggcaggccggcgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28363 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagccagcaatggcggcggcaggccggcgctggagactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28364 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 28365 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28366 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28367 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttctgtttgtactcaacaagatggaaaggttcagagactttatggtttggctactgttgctaa

SEQ ID NO: 28368 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgcta

SEQ ID NO: 28369 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28370 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaaggttcagagactttatggtttggcactgttctaa

SEQ ID NO: 28371 - DNA, 405 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagactgggcctttcgttttatctgttgtttgtcggtgaacgctctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28372 - DNA, 405 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagactgggcctttcgttttatctgttgtttgttggtgaacgctctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28373 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcgccagttatgttggaccgaatgttgcgtctcttggcttgttacaatatcctcacttgttcagttcgtactcaacaagatggaaagattcagagactttatggtttggctactgttgctaa

SEQ ID NO: 28374 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 28375 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 28376 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28377 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28378 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28379 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcaggtcgtactcaacaagatggaaagattcagagactttatggtttggctactgttgctaa

SEQ ID NO: 28380 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttagcttgttacaatatcctcacttgttcagttcgtactcaacaagatggaaaggttcagagactttatggtttggctactgttgctaa

SEQ ID NO: 28381 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggttgggcgactgttgctaa

SEQ ID NO: 28382 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28383 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28384 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28385 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacactctgatgcaccagctatgttggaccgaatgttgcgtctcttggcttgttacaatatcctcacttgttcagttcgtactcaacaagatggaaaagttcagagactttatggtttggctactgttgctaa

SEQ ID NO: 28386 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28387 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28388 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28389 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28390 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28391 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacctgatgcaccagttatgttggaccgaatgttgcttctcttggcttgttacaatatcctcacttgttcagttcgtactcaacaagatggaaaggttcagagactttatggtttggctactgttgctaa

SEQ ID NO: 28392 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28393 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28394 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28395 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaccccagcaggtggtggccggcgccggcaatggcggtggcaagcaggcgctggagacggtccagcggctgttgccggtgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28396 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaccccagcaggtggtggccatcgccagcaatggcggtggcaagcaggcgctggagacggtccagcggctgttgccggtgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28397 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaccccagcaggtggtggccatcgccagcaatggcggtggcaagcaggcgctggagacggtccagcggctgttgccggtgcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28398 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaccccagcaggtggtggccatcgccagcaatggcggtggcaagcaggcgctggagacgatccagcggctgttgccggtgcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28399 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaccccagcaggtggtggccatcgccagcaatggcggtggcaagcaggcgctggagacggtccagcggctgttgccggtgcctgatgcaccagttatgttggaccgaatgttgcgtctcttggcttgttacaatatcctcacttgttctgttcgtactcaacaagatggaaagattcagagcctttatggtttggctactgttgctaa

SEQ ID NO: 28400 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaccccagcaggtggtggccatcgccagcaatggcggtggcaagcaggcgctggaggcggtccagcggctgttgccggtgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28401 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaccccagcaggtggtggccatcgccagcaatggcggtggcaagcaggcgctggagacggtccagcggctgttgccggtgcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28402 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaccagttatgttggaccgaatgttgcgtctcttggcttgttacaatatcctcacttgttcagttcgtactcaacaagatggaaagattcagagactttatggtttggctactgttgctaa

SEQ ID NO: 28403 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaccagttatgttggaccgaatgttgcgtctcttggcttgttacaatatcctcacttgttcagttcgtactcaacaagatggaaaggttcagagactttatggtttggctactgttgctaa

SEQ ID NO: 28404 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacatgcaccagttatgttggaccgaatgttgcgtctcttggcttgttacaatatcctcacttgttcagttcgtactcaacaagatggaaagattcagagactttatggtttggctactggtgctaa

SEQ ID NO: 28405 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28406 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacatgcaccagttatgttggaccgaatgttgcgtctcttggcttgttacaatatcctcacttgttcagttcgtactcaacaagatggaaagattcagagactttatggtttggctactgttgctaa

SEQ ID NO: 28407 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacaccagttatgttggaccgaatgttgcgtctcttggcttgttacaatatcctcacttgttcagttcgtactcaacaagatggaaagattcagagactttatggtttggctactgttgctaa

SEQ ID NO: 28408 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacaccagttatgttggaccgaatgttgcgtctcttggcttgttacaatatcctcacttgttcagttcgtactcaacaagatggaaaggttcagagactttatggtttggctactgttgctaa

SEQ ID NO: 28409 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacaccagttatgttggaccgaatgttgcgtctcttggcttgttacaatatcctcacttgttctgttcgtactcaacaagatggaaaggttcagagactttatggtttggctactgttgctaa

SEQ ID NO: 28410 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacaccagttatgttggaccgaatgttgcgtctcttggcttgttacaatatcctcacttgttcagttcgtactcaacaagatggaaaggttcagagactttatgggttggctactgttgctaa

SEQ ID NO: 28411 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatttatgttggaccgaatgttgcgtctcttggcttgttacaatatcctcacttgttcagttcgtactcaacaagatggaaaggttcagagactttatggtttggctactgttgctaa

SEQ ID NO: 28412 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatttatgttggaccgaatgttgcgtctcttggcttgttacaatatcctcacttgttcagttcgtactcaacaagatggaaagattcagagactttatggtttggctactgttgctaa

SEQ ID NO: 28413 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatttatgttggaccgaatgttgcgtctcttggcttgttacaatatcctcacttgttcagttcgtactcaacaagatggaaaagttcagagactttatggtttggctactgttgctaa

SEQ ID NO: 28414 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaattcaccagttatgttggaccgaatgttgcgtctcttggcttgttacaatatcctcacttgttcagttcgtactcaacaagatggaaaggttcagagactttatggtttggctactgttgctaa

SEQ ID NO: 28415 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaattatgttggaccgaatgttgcgtctcttggcttgttacaatatcctcacttgttcagttcgtactcaacaagatggaaaggttcagagactttatggtttggctactgttgctaa

SEQ ID NO: 28416 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaattatgttggaccgaatgttgcgtctcttggcttgttacaatatcctcacttgttcagttcgtactcaacaagatggaaagattcagagactttatggtttggctactgttgctaa

SEQ ID NO: 28417 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaattatgttggaccgaatgttgcgtctcttggcttgttacaatatcctcacttgttcagttcgtactcaacaagatggaaagattcagagactttatggtttgctactgttgctaa

SEQ ID NO: 28418 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgttggaccgaatgttgcgtctcttggcttgttacaatatcctcacttgttcagttcgtactcaacaagatggaaaagttcagagactttatggtttggctactgttgctaa

SEQ ID NO: 28419 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgttggaccgaatgttgcgtctcttggcttgttacaatatcctcacttgttcagttcgtactcaacaagatggaaaggttcagagactttatggtttggctactgttgctaa

SEQ ID NO: 28420 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgttggaccgaatgttgcgtctcttggcttgttacaatatcctcacttgttcagttcgtactcaacaagatggaaaggttcagagcctttatggtttggctactgttgctaa

SEQ ID NO: 28421 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28422 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttctgttcgtactcaacgagatggaaaggttcagagactttatggtttggctactgttgctaa

SEQ ID NO: 28423 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 28424 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28425 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28426 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28427 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28428 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 28429 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggacggaatgttgcgtctcttgggttgttacaatatcctcacttgttcagttcgtactcaacaagatggaaaggttcagaggctgtagggtttggctactgttgctaa

SEQ ID NO: 28430 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 28431 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28432 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 28433 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28434 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28435 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28436 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcaacaagatggaaaggttcagagactttatggtttggctacctgttgctaa

SEQ ID NO: 28437 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatctgatgcaccagttatgtgggaccgaatgttgcgtctcttggcttgttacaatatcctcacttgttcagttcgtactcaacaagatggaaaggttcagagactttatggtttggctactgttgctaa

SEQ ID NO: 28438 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28439 - DNA, 335 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatatgttgcgtctcttggcttgttacaatatcctcacttgttcagttcgtactcaacaagatggaaagattcagagactttatggtttggctactgttgctaa

SEQ ID NO: 28440 - DNA, 335 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatatgttgcgtctcttggcttgttacaatatcctcacttgttcagttcgtactcaacaagattgaaaggttcagagactttatggtttggctactgttgctaa

SEQ ID NO: 28441 - DNA, 335 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatatgttgcgtctcttggcttgttacaatatcctcacttgttcagttcgtactcaacaagatggaaaggttcagagactttatggtttggctactgttgctaa

SEQ ID NO: 28442 - DNA, 335 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatatgttgcgtctcttggcttgttacaatatcctcacttgttcagttcgtactcaacaagatggaaaagttcagagactttatggtttggctactgttgctaa

SEQ ID NO: 28443 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatatgcaccagttatgttggactgaatgttgcatctcatgacttgttacaatatcctcacttgatcagttcgtactcaacaagatggaaaggttcacagactttatggtttggctactggtgctaa

SEQ ID NO: 28444 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28445 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 28446 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 28447 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28448 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28449 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28450 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatacaccagttatgttggaccgaatgttgcgtctcttggcttgttacaatatcctcacttgttctgttcgtactcaacaagatggaaaggttcagagactttatggtttggctactgttgctaa

SEQ ID NO: 28451 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagttatgttggaccgaatgttgcgtctcttggcttgttacaatatcctcacttgttcagttcgtactcaacaagatggaaaagttcagagactttatggtttggctactgttgctaa

SEQ ID NO: 28452 - DNA, 474 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagcggctgttgccggtgctgtgccaggcccacggcttgaccccggagcaggtggtggccatcgactgccctgctgcgtaacatcgttgctgctccataacatcaaacatcgacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28453 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagcaccagttatgttggaccgaatgttgcgtctcttggcttgttacaatatcctcacttgttcagttcgtactcaacaagatggaaaggttcagagactttatggtttggctactgttgctaa

SEQ ID NO: 28454 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagcaccagttatgttggaccgaatgttgcgtctcttggcttgttacaatatcctcacttgttcagttcgtactcaacaagatggaaaggttcagagactttatggtttgctactgttgctaa

SEQ ID NO: 28455 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagcaccagttatgttggaccgaatgttgcgtctcttggcttgttacaatatcctcacttgttcagttcgtactcaacaagatggaaagattcagagactttatggtttggctactgttgctaa

SEQ ID NO: 28456 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagcaatggcggcggcaggccggcgctggagactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28457 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatgtaccagttatgttggaccgaatgttgcgtctcttggcttgttacaatatcctcacttgttcagttcgtactcaacaagatggaaaggttcagagactttatggtttggctactgttgctaa

SEQ ID NO: 28458 - DNA, 277 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatggaaaggttcagagactttatggtttggctactgttgctaa

SEQ ID NO: 28459 - DNA, 277 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatggaaagattcagagactttatggtttggctactgttgctaa

SEQ ID NO: 28460 - DNA, 276 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatggaaagattcagagactttatggtttggctacgttgctaa

SEQ ID NO: 28461 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatgcatcagttatgttggaccgaatgttgcgtctcttggcttgttacaatatcctcacttgttcagttcgtactcaacaagatggaaaggttcagagactttatggtttggctactgttgctaa

SEQ ID NO: 28462 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatgcacctgttatgttggaccgaatgttgcgtctcttggcttgttacaatatcctcacttgttcagttcgtactcaacaagatggaaagattcagagactttatggtttggctactgttgctaa

SEQ ID NO: 28463 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28464 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 28465 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28466 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28467 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatgttgcgtctcttgtcttgttacaatatcctcacttgttcagttcgtactcaacaagatggaaaggttcagagactttatggtttggctactgttgctaa

SEQ ID NO: 28468 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagactttatggtttggctactt

SEQ ID NO: 28469 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28470 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaagattcagagactttatggtttggctaccgttgctaa

SEQ ID NO: 28471 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaagattcagagactttatggtttggctacgttgctaa

SEQ ID NO: 28472 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactttatgttggaccgaatgttgcgtctcttggcttgttacaatatcctcacttgttcagttcgtactcaacaagatggaaagattcagagactttatggtttggctactgttgctaa

SEQ ID NO: 28473 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactttatgttggaccgaatgttgcgtctcttggcttgttacaatatcctcacttgttcagttcgtactcaacaagatggaaaggttcagagactttatggtttggctactgttgctaa

SEQ ID NO: 28474 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactttatgttggaccgaatgttgcgtctcttggcttgttacaatatcctcacttgttcagttcgtactcaacaagatggaaaagttcagagactttatggtttggctactgttgctaa

SEQ ID NO: 28475 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactttatgttggaccgaatgttgcgtctcttggcttgttacaatatcctcacttgttcagttcgtactcaacaagatggaaaggttcagagtctttatggtttggctactgttgctaa

SEQ ID NO: 28476 - DNA, 477 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttggcaagcaggcgctggggccgggccagcggctggtgccggtgctgtgccaggcccacggcttgaccccggagcaggtggtggccatcgccagccacgatggcggcaagcaggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28477 - DNA, 477 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttggcaagcaggcgctggagacggtccagcggctgttgccggtgctgtgccaggcccacggcttgaccccggagcaggtggtggccatcgccagccacgatggcggcaagcaggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28478 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgcgtctcttggcttgttacaatatcctcacttgttcagttcgtactcaacaagatggaaagattcagagactttatggtttggctactgttgctaa

SEQ ID NO: 28479 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgcgtctcttggcttgttacaatatcctcacttgttcagttcgtactcaacaagatggaaaggttcagagactttatggtttggctactgttgctaa

SEQ ID NO: 28480 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgccggtgctgtgccaggcccacggcttgaccccggagcaggtggctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28481 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgccggtgctgtgccaggcccacggcttgaccccggagcctgtggctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28482 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgccggtgctgtgccaggcccacggcttgaccccggagcaggtggctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28483 - DNA, 415 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgccggtgctgtgccaggcccacggcttgaccccggagcaggtggtggccatcgctgatgcaccagttatgttggaccgaatgttgcgtctcttggcttgttacaatatcatcacttgttcagttcgtactcaacaagatggaaagattcagagactttatggtttggctatgttgctaa

SEQ ID NO: 28484 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgccggtgctgtgccaggcccacggcttgaccccggagcaggtggctgatgcaccagttatgttggtccgaatgttgcgtctcttggcttgttacaatatcctcacttgttcagttcgtactcaacaagatggaaaggttcagagactttatggtttggctactgttgctaa

SEQ ID NO: 28485 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgccggtgctgtgccaggcccacggcttgaccccggagcaggtggctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28486 - DNA, 391 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgccaccaatattgctggcgatggcggccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28487 - DNA, 391 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgccaccaatattgctggcgatggcggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28488 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28489 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28490 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28491 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28492 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggtttggctactgttgttaa

SEQ ID NO: 28493 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagattgaaagattcagagactttatggtttggctactgttgctaa

SEQ ID NO: 28494 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttatgttggaccgaatgttgcgtctcttggcttgttacaatatcctcacttgttcagttcgtactcaacaagatggaaagattcagagactttatggtttggctactgttgctaa

SEQ ID NO: 28495 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttatgttggaccgaatgttgcgtctcttggcttgttacaatatcctcacttgttcagttcgtactcaacaagatggaaaggttcagagactttatggtttggctactgttgctaa

SEQ ID NO: 28496 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttagctcattaaactccagaaacccgcggccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28497 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttagctcattaaactccagaaacccgcggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28498 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgttggaccgaatgttgcgtctcttggcttgttacaatatcctcacttgttcagttcgtactcaacaagatggaaaggttcagagactttatggtttggctactgttgctaa

SEQ ID NO: 28499 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgttggaccgaatgttgcgtctcttggcttgttacaatatcctcacttgttcagttcgtactcaacaagatggaaaagttcagagactttatggtttggctactgttgctaa

SEQ ID NO: 28500 - DNA, 468 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgtaaaaatatcccatggaagtcgtagttatgttgtttacctatccaatgaattgtcacatgctaaggtttaatgcaaatcggctacattatggccttcctagtaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28501 - DNA, 404 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactggggtcaagccgtgggcctggcacagcaccggcaacagccgctggatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28502 - DNA, 404 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactggggtcaagccgtgggcctggcacagcaccggcaacagccgctggatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28503 - DNA, 404 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactggggtcaagccgtgggcctggcacagcaccggcaacagccgctggatgcaccagttatgttggaccgaatgttgcgtctcttggcttgttacaatatcctcacttgttcagttcgtactcaacaagatggaaagattcagagactttatggtttggctactgttgctaa

SEQ ID NO: 28504 - DNA, 391 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactggcacagcaccggcaacagccgctggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28505 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactggaccgaatgttgcgtctcttggcttgttacaatatcctcacttgttcagttcgtactcaacaagatggaaagattcagagactttatggtttggctactgttgctaa

SEQ ID NO: 28506 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactggaccgaatgttgcgtctcttggcttgttacaatatcctctcttgttcagttcgtactcaacaagatggaaaggttcagagactttatggtttggctactgttgctaa

SEQ ID NO: 28507 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactggaccgaatgttgcgtctcttggcttgttacaatatcctcacttgttcagttcgtactcaacaagatggaaaggttcagagactttatggtttggctactgttgctaa

SEQ ID NO: 28508 - DNA, 471 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgcccacggcttgaccccggagcaggtggggggcatcgccagcaatattggtggcaagcaggcgctggagacggtgcaggcgctgttgccggtgctgtgccaggcccaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 28509 - DNA, 471 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgcccacggctggaccccggagcgggtggtggccatagccagctatattggtggcaatcaggcgcgggagacggtgcaggcgcttttgccggtgctgtgccaggcccaccctgatgcacccgttatgttggaccgaatgttgcgtctcttggcttgttacaatatcctcacttgttcagttcgtactcaaccagatggaaagattcagagactttatggtttggctactgttgctaa

SEQ ID NO: 28510 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgcaccagttatgttggaccgaatgttgtgtctctcggcttgttacaataacctcacctgttcacttcgaacttatcaagatggaaaggttcagagactttctgcaaaagggactgacactaa

SEQ ID NO: 28511 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgcaccagttatgttggaccgaatgttgcgtctcttggcttgttacaatatcctcacttgttcagttcgtactcaacaagatggaaagattcagagactttatggtttggctactgttgctaa

SEQ ID NO: 28512 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgcaccagttatgttggaccgaatgttgcgtctcttggcttgttacaatatcctcacttgttctgttcgtactcaacaagatggaaaggttcagagactttatggtttggctactgttgctaa

SEQ ID NO: 28513 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgcaccagttatgttggaccgaatgttgcgtctcttggcttgttacaatatcctcacttgttcagttcgtactcaacaagatggaaagattcagagactttatggtttggctatgctaa

SEQ ID NO: 28514 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgcaccagttatgttggaccgaatgttgcgtctcttggcttgttacaatatcctcacttgttcagttcgtactcaacaagatggaaaggttcagagactttatggtttggctactgttgctaa

SEQ ID NO: 28515 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgcaccagttatgttggaccgaatgtggcgtctcttggcttgttacaatatcctcacttgttcagttcgtactcaacaagatggaaagattcagagactttatggtttggctactgttgctaa

SEQ ID NO: 28516 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgcaccagttatgttggaccgaatgttgcgtctcttggcttgttacaatatcctcacttgttcagttcgtactcaacaagatggaaaggttcagagactttatggtttggctactgttgctac

SEQ ID NO: 28517 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgcaccagttaagttggaccgaatgttgcgtctcttggcttgttacaatatcctcacttgttcagttcgtactcaacaagatggaaaggttcagagactttatggtttggctactgttgctaa

SEQ ID NO: 28518 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcagcagttatgttggaccgaatgttgcgtctcttggcttgttacaatatcctcacttgttcagttcgtactcaacaagatggaaagattcagagactttatggtttggctactgttgctaa

SEQ ID NO: 28519 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28520 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28521 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28522 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28523 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28524 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcccttgttcagttcgtactcaacaagatggaaagattcagagactttatggtttggctactgttgctaa

SEQ ID NO: 28525 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctctcggcttgttacaatatcctcacttgttcagttcgtactcaacaagatggaaaggttcagagactttatggtttggctactgttgctaa

SEQ ID NO: 28526 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttctaa

SEQ ID NO: 28527 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaaggtggaaaggttcagagactttatggtttggctactgttgctaa

SEQ ID NO: 28528 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctacctgttgctaa

SEQ ID NO: 28529 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 28530 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 28531 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcgtggcttgttacaatatcctcacttgttcagttcgtactcaacaagatggaaagattcagagactatatggtttggctactgttgctaa

SEQ ID NO: 28532 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggctggttacaatatcctcacttgttcagttcgtactcaacaagatggaaaggttcagagactttatggtttggctactgttgctaa

SEQ ID NO: 28533 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtacccaacaagatggaaagattcagagactttatggtttggctactgttgctaa

SEQ ID NO: 28534 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcttactcaacaagatggaaaggttcagagactttatggtttggctactgttgctaa

SEQ ID NO: 28535 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgtgcagttcgtactcaacaagatgaaaaggttcagagactttatggttggctactgttgctaa

SEQ ID NO: 28536 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcttctcttggcttgttacaatatcctcacttgttcagttcgtactcaacaagatggaaagattcagagactttatggtttggctactgttgctaa

SEQ ID NO: 28537 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagtttccgagcctttatggtttggctactgttgctaa

SEQ ID NO: 28538 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 28539 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 28540 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggttactgttgctaa

SEQ ID NO: 28541 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctacgttgctaa

SEQ ID NO: 28542 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgca

SEQ ID NO: 28543 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttctaa

SEQ ID NO: 28544 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgtgacaatatcctcatttgttcagttcgtactcaacaagatggaaaggttcagagactttatggtttggctactgatgctaa

SEQ ID NO: 28545 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaagattcagagactttatggtttggctactgttgctaa

SEQ ID NO: 28546 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaaggttcatagactttatggtttggctactgttgctaa

SEQ ID NO: 28547 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaacgttgcgtctcttggcttgttacaatatcctcacttgttctgttcgtactcaacaagatggaaaggttcagagactttatggtttggctactgttgctaa

SEQ ID NO: 28548 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcgtcacttgttcagttcgtactcaacaagatggaaaggttcagagactttatggtttggctactgttgctaa

SEQ ID NO: 28549 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctatgttgctaa

SEQ ID NO: 28550 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 28551 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttaagttcgtactcaacaagatggaaagattcagagactttatggtttggctactgttgctaa

SEQ ID NO: 28552 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaactagatggaaagattcagagactttatggtttggctactgttgctaa

SEQ ID NO: 28553 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggacctaatgttgcgtctcttggcttgttacaatatcctcgcttgttcagttcgtactcagcaagatggaaaagttcagagactttatggtttggctactgttgctaa

SEQ ID NO: 28554 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcatactcaacaagatggaaagattcagagactttatggtttggctactgttgctaa

SEQ ID NO: 28555 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaaaatcctcacttgttcagttcgtactcaacaagatggaaaggttcagagactttatggtttggctactgttgctaa

SEQ ID NO: 28556 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtatcttggcttgttacaatatcctcacttgttcagttcgtactcaacaagatggaaagattcagagactttatggtttggctactgttgctaa

SEQ ID NO: 28557 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 28558 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 28559 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28560 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 28561 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgaaccagttatgttggaccgaacgttgcgtctcttggcttgttacaatatcctcacttgttctgttcgtactaacaagatggaaaggttcagagactttatggtttggctactgttgctaa

SEQ ID NO: 28562 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgaggaagcggaagagcgcccaatacgcaaaccctgatgcaccagttatgttggaccgaatgttgcgtctcttggcttgttacaatatcctcacttgttcagttcgtactcaacaagatggaaagattcagagactttatggtttggctactgttgaa

SEQ ID NO: 28563 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgaggaagcggaagagcgcccaatacgcaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28564 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgagcctttcgttttatctgttgtttgtcggtgaacgctctcctgagtaggacaaatccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28565 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgagcctttcgttttatctgttgtttgtcggtgaacgctctcctgagtaggacaaatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28566 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgagcctttcgttttatctgttgtttgtcggtgaacgctctcctgagtaggacaaatccctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 28567 - DNA, 433 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgacggtccagcggctgttgccggtgctgtgccaggcccacggcttgaccccggagcaggtggtggccatcgctgatgcaccagttatgttggaccgaatgttgcgtctcttggcttgttacaatatcctcacttgttcagttcgtactcgacaagatggaaagattcagagactttatggtttggctactgttgctaa

SEQ ID NO: 28568 - DNA, 433 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgacggtccagcggctgttgccggtgctgtgccaggcccacggcttgaccccggagcaggtggtggccatcgctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28569 - DNA, 466 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgaccttaggcgacttttgaacgcgcaataatggtttctgaccgctgcgccttatccggtaactatcgtcttaatgcctcgacttcgctgctacccaaggttgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28570 - DNA, 421 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgaccccccagcaggtggtggccatcgccagcaatggcggtggcaagcaggcgctggaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28571 - DNA, 391 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgacacagcaccggcaacagccgctggaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28572 - DNA, 387 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactcttcctggctagcggtacgcgtaccctgatgcaccagttatgttggaccgaatgttgcgtctcttggcttgttacaatatcctcacttgttcagttcgtactcaacaagatggaaagattcagagactttatggtttggctactgttgccaa

SEQ ID NO: 28573 - DNA, 387 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactcttcctggctagcggtacgcgtaccctgaagcaccagatatgttggaccgaatgttgcgtctcttggcttgttacaatatcctcgcttgttcagttcgtgctcagcaaggtggaaagattcagagtctttatggattggctactgttgctaa

SEQ ID NO: 28574 - DNA, 387 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactcttcctggctagcggtacgcgtaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28575 - DNA, 387 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactcttcctggctagcggtacgcgtaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28576 - DNA, 387 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactcttcctggctagcggtacgcgtaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28577 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28578 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28579 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28580 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28581 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttctgttcgtactcaacaagatggaaagtttcagagactttatggtttggctactgttgctaa

SEQ ID NO: 28582 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgtgtctcttggcttgttacaatatcctcacttgttcagttcgtactcaacaagatggaaagattcagagactttatggtttggctactgttgctaa

SEQ ID NO: 28583 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28584 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28585 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 28586 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagtcatgttggaccgaatgttgcgtctcttggcttgttacaatatcctcacttgttctgttcgtactcaacaagatggaaaggttcagagactttatggtttggctactgttgcaa

SEQ ID NO: 28587 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactccttatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28588 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactccctgatgcaccagttatgttggaccgaatgttgcgtctcttggcttgttacaatatcctcacttgttcagttcgtactcaacaagatggaaagattcagagactttatggtttgctactgttgctaa

SEQ ID NO: 28589 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28590 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28591 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactcaccagttatgttggaccgaatgttgcgtctcttggcttgttacaatatcctcacttgttcagttcgtactcaacaagatggaaaggttcagagactttatggtttggctactgttgctaa

SEQ ID NO: 28592 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactcaccagttatgttggaccgaatgttgcgtctcttggcttgttacaatatcctcacttgttcagttcgtactcaacaagatggaaagattcagagactttatggtttggctactgttgctaa

SEQ ID NO: 28593 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactatgttggaccgaatgttgcgtctcttggcttgttacaatatcctcacttgttcagttcgtactcaacaagatggaaaggttcagagactttatggtttggctactgttgctaa

SEQ ID NO: 28594 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactatgttggaccgaatgttgcgtctcttggcttgttacaatatcctcacttgttcagttcgtactcaacaagatggaaagattcagagactttatggtttggctactgttgctaa

SEQ ID NO: 28595 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactatgttggaccgaatgttgcgtctcttggcttgttacaatatcctcacttgttctgttcgtactcaacaagatggaaaggttcagagactttatggtttggctactgttgctaa

SEQ ID NO: 28596 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactatgttggaccgaatgttgcatctcttggcttgttacaatatcctcacttgttcagttcgtactcaacaagatggaaagattcagagactttatggtttggctactgttgctaa

SEQ ID NO: 28597 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactatgttgcgtctcttggcttgttacaatatcctcacttgttcagttcgtactcaacaagatggaaaggttcagagactttatggtttggctactgttgctaa

SEQ ID NO: 28598 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactatgttgcgtctcttggcttgttacaatatcctcacttgttcagttcgtactcaacaagatggaaaagttcagagactttatggtttggctactgttgctaa

SEQ ID NO: 28599 - DNA, 439 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactatgccggtgctgtgccaggcccacggcttgaccccggagcaggtggtggccatcgccagccacgatggcggcaagcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28600 - DNA, 439 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactatgccggtgctgtgccaggcccacggcttgaccccggagcaggtggtggccatcgccagccacgatggcggcaagcactgatgcaccagttatgttggaccgaatgttgcgtctcttggcttgttacaataccctcacttgttcagttcgtactcaacaagatggaaaggttcagagactttatggtttggctactgttgctaa

SEQ ID NO: 28601 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28602 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaagattcagagactttatggtttggctactgttgctaa

SEQ ID NO: 28603 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28604 - DNA, 441 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactagccggtgctgtgccaggcccacggcttgaccccggagcaggtggtggccatcgcctggcacagcaccggcaacagccgctggatgcaccagttatgttggaccgaatgttgcgtctcttggcttgttacaatatcctcacttgttcagttcgtactcaacaagatggaaagattcagagactttatggtttggcactgttgctaa

SEQ ID NO: 28605 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactagccggtgctgtgccaggcccacggcttgaccccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28606 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactagccggtgctgtgccaggcccacggcttgaccccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28607 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactagccacgatggcggcaagcaggcgctggagacggtccagcggctgttctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28608 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactagcaccagttatgttggaccgaatgttgcgtctcttggcttgttacaatatcctcacttgttcagttcgtactcaacaagatggaaagattcagagactttatggtttggctactgttgctaa

SEQ ID NO: 28609 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactagcaccagttatgttggaccgaatgttgcgtctcttggcttgttacaatatcctcacttgttcagttcgtactcaacaagatggaaaggttcagagactttatggtttggctactgttgctaa

SEQ ID NO: 28610 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactagcaccagttatgttggaccgaatgttgcgtctcttggcttgttacaatatcctcacttgttctgttcgtactcaacaagatggaaaggttcagagactttatggtttggctactgttgctaa

SEQ ID NO: 28611 - DNA, 445 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactagcaatggcggtggcaagcaggcgctggagactgcatgcatggcgcaatgcactgacgggtgccccgctcaacttgaccccccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28612 - DNA, 445 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactagcaatggcggtggcaagcaggcgctggagactgcatgcatggcgcaatgcactgacgggtgccccgctcaacttgaccccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28613 - DNA, 455 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactagcaaatatttcttgtcaaaaatgctccactgacgttccataaattcccctcggtatccaattagagtctcatattcactctcaatccaaataatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28614 - DNA, 423 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactacttgaccccggagcaggtggtggccatcgccagccacgatggcggcaagcaggcgctggactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28615 - DNA, 422 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactacttgaccccggagcaggtggtggccatcgccagccacgatggcggcaacagccgctggactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28616 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactactggcgatggccaccccctgctccgggttcaagccgtgggcctggcacagcaccggcaacagccgctggaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28617 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactactggcgatggccaccacctgctccggggtcaagccgtgggcctggcacagcaccggcaacaggcgctggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28618 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28619 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaaggttcagagactttatggtttggctactgttgcta

SEQ ID NO: 28620 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28621 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtacgcaacaagatggaaagattcagagactttatggtttggctactgttgctaa

SEQ ID NO: 28622 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactactgatgcaccagttatgttggacagaatgttgcgtctcttggcttgttacaatatcctcacttgttcagttcgtactcaacaagatggaaagattcagagactttatggtttggctactgttgctaa

SEQ ID NO: 28623 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28624 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28625 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccggcaacagccgctggaccgtctccagcgccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28626 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccggcaacagccgctggaccgtctccagcgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28627 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccggcaacagccgctggaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28628 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccggcaacagccgctggaccgtctccaacaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28629 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28630 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccggcaacagccgctggaccgtctccagcaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28631 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccggcaacagccgctggaccgtctccagcaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28632 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccgaatgttgcgtctcttggcttgttacaatatcctcacttgttcagttcgtactcaacaagatggaaagattcagagactttatggtttggctactgttgctaa

SEQ ID NO: 28633 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccgaatgttgcgtctcttggcttgttacaatatcctcacttgttcagttcgtactcaacaagatggaaaggttcagagactttatggtttggctactgttgctaa

SEQ ID NO: 28634 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28635 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28636 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28637 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccctgatgcaccagttatgttggaccgaatgttgcatctcttggcttgttacaatatcctcccttgttcagttcgtactcaacaagatggaaagattcagagactttatggtttggctactgttgctaa

SEQ ID NO: 28638 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccagttatgttggaccgaatgttgcgtctcttggcttgttacaatatcctcacttgttcagttcgtactcaacaagatgtaaaggttcagagactttatggtttggctactgttgctaa

SEQ ID NO: 28639 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccagttatgttggaccgaatgttgcgtctcttggcttgttacaatatcctcacttgttcagttcgtactcaacaagatggaaagattcagagactttatggtttggctactgttgctaa

SEQ ID NO: 28640 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaccagttatgttggaccgaatgttgcgtctcttggcttgttacaatatcctcacttgttcagttcgtactcaacaagatggaaaggttcagagactttatggtttggctactgttgctaa

SEQ ID NO: 28641 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaattttattttgactgatagtgacctgttcgttgcaacaaattgataagcaatgctttcttataatgccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28642 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaattatgttggaccgaatgttgcgtctcttggcttgttacaatatcctcacttgttcagttcgtactcaacaagatggaaagattcagagactttatggtttggctactgttgctaa

SEQ ID NO: 28643 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaattatgttggaccgaatgttgcgtctcttggcttgttacaatatcctcacttgttcagttcgtactcaacaagatggaaaggttcagagactttatggtttggctactgttgctaa

SEQ ID NO: 28644 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28645 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 28646 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28647 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaagtatcaggacatgatcgcagcgttgccagagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28648 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaagtatcaggacatgatcgcagcgttgccagagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28649 - DNA, 397 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaggcgcagcggtcgggctgaacggggggttaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28650 - DNA, 397 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaggcgcagcggtcgggctgaacggggggttaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28651 - DNA, 448 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaactggaaagcgggcagtgagcgcaacgcaattaatacgcgtaccgctagccaggaagagtttgtagaaacgcaaaaaggccatccgtgatgctccagttatgttggaccgaatgttgcgtctcttggcttgttacaatatcctcacttgttcagttcgtactcaacaagatggaaaggttcagagactttatggtttggctactgttgctaa

SEQ ID NO: 28652 - DNA, 384 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacgtccagcggctgttgcctcctgatgcaccagttatgttggaccgaatgctgcgtctcttggcttgttacaatatcctcacttgttcagttcgtactcaacaagatggaaaggttcagagactttatggtttggctactgttgctaa

SEQ ID NO: 28653 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacgtaattcaacagaaattatatgataatcatcgcaagaccggcaacaggattcaatcttaagaaactttatttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28654 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacgtaattcaacagaaattatatgataatcatcgcaagaccggcaacaggattcaatcttaagaaactttatttgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 28655 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacggtcaccgtaaccagcaaatcaatatcactgtgtggcttcaggccgccatccactgcggagccgtacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28656 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacggtcaccgtaaccagcaaatcaatatcactgtgtggcttcaggccgccatccactgcggagccgtacatctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28657 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacggtcaccgtaaccagcaaatcaatatcactgtgtggcttcaggccgccatccactgcggagccgtacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28658 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacggggtcaagccgtgggcctggcacagcaccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28659 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacgccagcaacgcggcctttttacggttcctggccatgcaccagttatgttggaccgaatgttgcgtctcttggcttgttacaatatcctcacttgttcagttcgtactcaacaagatggaaagattcagagactttatggtttggctactgttgctaa

SEQ ID NO: 28660 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28661 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28662 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaaggttcagagactttatggtttggctactgttgttaa

SEQ ID NO: 28663 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28664 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28665 - DNA, 471 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccgtctccagcgcctgctggcccccagcgtggctggcgatggccaccacctgcccgggggtcaggccgggggcctggcacagcaccggcaacagccgctggaccgacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28666 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccggtgctgtgccaggcccacggcttgaccccggagcaggtggctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28667 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccggtgctgtgccaggcccacggcttgaccccccctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 28668 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccggcggatttgtcctactcaggagagcgttcaccgacaaacaacagatgaaacgaaaggcccagtctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28669 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccggcggatttgtcctactcaggagagcgttcaccgacaaacaacagataaaacgaaaggctcagtctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28670 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccggcaacagcgcctgcaccgtctccagcgcctgcttgccaccaatattgctggcgatggccctgatgtaccagttatgttggaccgaatgttgcgtctcttggcttgttacaatatcctcacttgttcagttcgtactcaacaagatggaaaagttcagagactttatggtttggctactgttgctaa

SEQ ID NO: 28671 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28672 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccggcaacagccgctggaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28673 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccggcaacagccgctggaccgtctccagcgccctgatgcaccagttatgttggaccgaatgttgcgtctcttggcttgttacaatatcctcacttgttcagttcgtactcgacaagatggaaagattcagagactttatggtttggctactgttgctaa

SEQ ID NO: 28674 - DNA, 416 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccgagcaggtggtggccatcgccagccacgatggcggcaagcaggcgctggactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28675 - DNA, 416 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccgagcaggtggtggccatcgccagccacgatggcggcaagcaggcgctggactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28676 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgttggaccgaatgttgcgtctcttggcttgttacaatatcctcacttgttcagttcgtactcaacaagatggaaaggttcagagactttatggtttggctactgttgctaa

SEQ ID NO: 28677 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgttggaccgaatgttgcgtctcttggcttgttacaatatcctcacttgttcagttcgtactcaacaagatggaaagattcagagactttatggtttggctactgttgctaa

SEQ ID NO: 28678 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgttggaccgaatgttgcgtctctgggcttgttacaatatcctcacttgttcagttcgtactcaacaagatggaaagattcagagactttatggtttggctactgttgctaa

SEQ ID NO: 28679 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccctgttggaccgaatgttgcgtctcttggcttgttacaatatcctcacttgttctgttcgtactcaacaagatggaaaggttcagagactttatggtttggctactgttgctaa

SEQ ID NO: 28680 - DNA, 474 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccccggagcaggtggtggccatcgccagccacgatggcggcaagcaggcgctggagacggtccagcggctgttgccggtgctgtgccaggcccacggcttgaccccccagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28681 - DNA, 368 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaacccccctgatgcaccagttatgttggaccgaatgttgcgtctcttggcttgttacaatatcctcacttgttcagttcgtactcaacaagatggaaaagttcagagactttatggtttggctacgttgctaa

SEQ ID NO: 28682 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccccccagcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28683 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccccccagcatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28684 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaaggttcagagactttatggtttggctactgttgctaa

SEQ ID NO: 28685 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaagattcagagactttatggtttggctactgttgctaa

SEQ ID NO: 28686 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaaggttcagagactttatggtttggcttactgttgctaa

SEQ ID NO: 28687 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccagttatgttggaccgaatgttgcgtctcttggctcgttacaatatcctcacttgttcagttcgtactcaacaagatggaaaggttcagagactttatggtttggctactgttgctaa

SEQ ID NO: 28688 - DNA, 457 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccaggcccacggcttgaccccccagcaggtggtggccatcgccagcaatggcggtggcaagcaggcgctggagacggtccagcggctgttgccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28689 - DNA, 457 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccaggcccacggcttgaccccccagcaggtggtggccatcgccagcaatggcggtggcaagcaggcgctggagacggtccagcggctgttgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28690 - DNA, 457 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccaggcccacggcttgaccccccagcaggtggtggccatcgccagcaatggcggtggcaagcaggcgctggagacggtccagcggctgttgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28691 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccacgatggcggcaagcaggcgctggagactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28692 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccacgatggcggcaagcaggcgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28693 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccacgatggcggcaagcaggcgctggagactgatgcaccagttatgttggaccgaatgttgcgtctcgtggcttgttacaatatcctcacttgttcagttcgtactcaacaagatggaaaggttcagagactttatggtttggctactgttgctaa

SEQ ID NO: 28694 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccacgatggcggcaacagccgctggagactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28695 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccacgatggcgacaagcaggcgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28696 - DNA, 460 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccaatgaaaaggggcagccgccacccatgaaatatataggacccctataggactcatgtgcatattaaccgtttgccacccatgctttcatatccactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28697 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28698 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28699 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28700 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 28701 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28702 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaatgcaccagttatgttggaccgaatgttgcgtctcttggcttgttacaatatcctcacttgttcagttcgtactcaacaagatggaaagattcagagactatatggtttggctactgttgctaa

SEQ ID NO: 28703 - DNA, 465 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaagcaacaatgctctccagcgccggcctgccgccgccattgctggcgatggccaccacctgctgaggggtcaagccgtgggcctggcacagcaccggcaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28704 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28705 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28706 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttctgttcgtactcaacaagatggaaaggttcagagactttatggtttggctactgttgctaa

SEQ ID NO: 28707 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttcagttcgtactcaacaagatggaaaggttcagagactttatggtttggctactgtggctaa

SEQ ID NO: 28708 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttcagttcgtactcaacaagatggaaaagttcagagactttatggtttggctactgttgctaa

SEQ ID NO: 28709 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgttatgttggaccgaatgttgcgtctcttggcttgttacaatatcctcacttgttcagttcgtactcaacaagatggaaaggttcagagactttatggtttggctactgttgctaa

SEQ ID NO: 28710 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgttatgttggaccgaatgttgcgtctcttggcttgttacaatatcctcacttgttctgttcgtactcaacaagatggaaagattcagagactttatggtttggctactgttgctaa

SEQ ID NO: 28711 - DNA, 459 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgtcaaaagtaataaatgcatgtgattgagtaaaatattgatcaccaacaatttttttgaataaaatcaattaattacatccacaattgggacaataacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28712 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgtactcaacaagatggaaaggttcagagactttatggtttggctactgttgctaa

SEQ ID NO: 28713 - DNA, 377 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacggcaagcaggcgctggagaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28714 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgcagtggaggcagtgcatgcatggcgcaatgcactgagcggggtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28715 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 28716 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28717 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28718 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaaagttcagagactttatggtttggctatgttgctaa

SEQ ID NO: 28719 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28720 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28721 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28722 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28723 - DNA, 410 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgaccaggaacaagcacatcaaccccaacgagtggtggaaggtgtaccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28724 - DNA, 410 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgaccaggaacaagcacatcaaccccaacgagtggtggaaggtgtaccccctgatgcaccagttatgttggaccgaatgttgcgtctcttggcttgttacaatatcctctcttgttctgttcgtactcaacaagatggaaaggttcagagactttatggtttggctactgtggctaa

SEQ ID NO: 28725 - DNA, 410 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgaccaggaacaagcacatcaaccccaacgagtggtggaaggtgtaccccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28726 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28727 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28728 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28729 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28730 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28731 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttactatatcctcacttgttcagttcgtactcaacaagatggaaaggttcagagactttatggtttggctactgttgctaa

SEQ ID NO: 28732 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttgtggtttggctactgttgctaa

SEQ ID NO: 28733 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactaacaagatggaaaggttcagagactttatggtttggctactgttgctaa

SEQ ID NO: 28734 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgtcgcgtctcttggcttgttacaatatcctcacttgttcagttcgtactcaacaagatggaaagattcagagactttatggtttggctactgttgctaa

SEQ ID NO: 28735 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggtttgttacaatatcctcacttgttcagttcgtactcaacaagatggaaaggttcagagactttatggtttggctactgttgctaa

SEQ ID NO: 28736 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggatactgttgctaa

SEQ ID NO: 28737 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 28738 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggcaactgttgctaa

SEQ ID NO: 28739 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 28740 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagacggaaaggttcagagactttatggtttggctactgctgctaa

SEQ ID NO: 28741 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 28742 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcactttttcagttcgtactcaacaagatggaaagattcagagcctttatggtttggctactgttgctaa

SEQ ID NO: 28743 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttgacttgttacaatatcctcacttgttcagttcgtactcaacaagatggaaagattcagagactttatggtttggctactgttgctaa

SEQ ID NO: 28744 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttctgttcgtactcaacaagatggaaaggttcagagactttatggtttggcactgttgctaa

SEQ ID NO: 28745 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccgtgggcctggcacagcaccggcaacagcgcctgcaccgtctccagccctgatgcaccagttatgttgaaccgaatgttgcgtctcttggcttgttacaatatcctcacttgttcagttcgtactcaacaagatggaaagattcagagactttatggtttggctactgttgctaa

SEQ ID NO: 28746 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccgtgggcctggcacagcaccggcaacagcgcctgcaccgtctccagccctgatgcaccagttatgttggaccgaatgttgcgtctcttggcttgttacaatatcctcacttgttcagttcgtactcaacaagatgggaagattcagagactttatggtttggctactgttgctaa

SEQ ID NO: 28747 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccgtgggcctggcacagcaccggcaacagcgcctgcaccgtctccagccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28748 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttctgttcgtactcaacaagatggaaaggttcagagactttatggtttggcactgttgctaa

SEQ ID NO: 28749 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28750 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28751 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28752 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggattgttacaatatcctcacttgttcagttcgtactcaacaagatggaaaagttcagagactttatggtttggctactgttgctaa

SEQ ID NO: 28753 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 28754 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 28755 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactggtgctaa

SEQ ID NO: 28756 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28757 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcccttgttcagttcgtactcaacaagatggaaaggttcagagactttatggtttggctactgttgataa

SEQ ID NO: 28758 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 28759 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28760 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 28761 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 28762 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgctaa

SEQ ID NO: 28763 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttctgttcgtactcaacaagatggaaaggttcagagactttatggtttggctattgttgctaa

SEQ ID NO: 28764 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 28765 - DNA, 427 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacccgttattaaaaactagccgttaaaaaactagccgttattaaaactagccggtaaaaaactagccgctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28766 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28767 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28768 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28769 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacccctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 28770 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28771 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccagttatgttggaccgaatgttgcgtctcttggcttgttacaatatcctcacttgttcagttcgtactcaacaagatggaaaggttcagagactttatggtttggctactgttgctaa

SEQ ID NO: 28772 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccagttatgttggaccgaatgttgcgtctcttggcttgttacaatatcctcacttgttcagttcgtactcaacaagatggaaagattcagagactttatggtttggctactgttgctaa

SEQ ID NO: 28773 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccaggccgacgaaatgcagaggtacgtggaggagaaccagaccaggaacaagcacatcaaccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28774 - DNA, 381 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccacctgctccggggtcaggcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28775 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccacctgctccggggtcaagccgggggcctggcacagcaccggcaacagccgctggaccgtctccagcgcctctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28776 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccacctgctccggggtcaacccgtgggcctggcacagcaccggcaacagccgctggaccgtctccagcgcctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28777 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28778 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccaccagttatgttggaccgaatgttgcgtctcttggcttgttacaatatcctcacttgttcagttcgtactcaacaagatggaaagattcagagactttatggtttggctactgttgctaa

SEQ ID NO: 28779 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccaccagttatgttggaccgaatgttgcgtctcttggcttgttacaatatcctcacttgttcagttcgtactcaacaagatggaaaggttcagagactttatggtttggctactgttgctaa

SEQ ID NO: 28780 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatgttggaccgaatgttgcgtctcttggcttgttacaatatcctcacttgttcagttcgtactcaacaagatggaaaggttcagagactttatggtttggctactgttgctaa

SEQ ID NO: 28781 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatgttggaccgaatgttgcgtctcttggcttgttacaatatcctcacttgttcagttcgtactcaacaagatggaaaagttcagagactttatggtttggctactgttgctaa

SEQ ID NO: 28782 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28783 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 28784 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28785 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28786 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28787 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28788 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacagttatgttggaccgaatgttgcgtctcttggcttgttacaatatcctcacttgttcagttcgtactcaacaagatggaaaggttcagagactttatggtttggctactgttgctaa

SEQ ID NO: 28789 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacagttatgttggaccgaatgttgcgtctcttggcttgttacaatatcctcacttgttcagttcgtactcaacaagatggaaagattcagagactttatggtttggcaactgttgctaa

SEQ ID NO: 28790 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacagttatgttggaccgaatgttgcgtctcttggcttgttacaatatcctcacttgttcagttcgtactcaacaagatggaaaagttcagagactttatggtttggctactgttgctaa

SEQ ID NO: 28791 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacagttatgttggaccgaatgttgcgtctcttggcttgttacaatatcctcacttgttcagttcgtactcaacaagatggaaagattcagagactttatggtttggctactgttgctaa

SEQ ID NO: 28792 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacagataccaaatactgttcttctagtgtagccgtagttaggccaccacttcaagctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 28793 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacagataccaaatactgttcttctagtgtagccgtagttaggccaccacttcaagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28794 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacagataccaaatactgttcttctagtgtagccgtagttaggccaccacttcaagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28795 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacacggatggcctttttgcgtttctacaaactcttcctggctagcggtacgcgtattaattgcgttgcgctcactgcccgctttccagtcgggaaacctgtcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28796 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacacgcaattaatacgcgtaccgctagccaggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28797 - DNA, 455 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacaccccccagcaggtggtggccatcgccagcaataatggtggcaagcaggcgctggagacggtccagcggctgttgccggtgctgtgccaggcccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28798 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28799 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 28800 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28801 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28802 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgctgcgtctcttggcttgttacaatatcctcacttgttcagttcgtactcaacaagatggaaaggttcagagactttatggtttggctactgttgctaa

SEQ ID NO: 28803 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcggttcgtactcaacaagatggaaagattcagagactttatggtttggctactgttgctaa

SEQ ID NO: 28804 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgtcgcgtctcttggcttgttacaatatcctcacttgttcagttcgtactcaacaagatggaaagattcagagactttatggtttggctactgttgctaa

SEQ ID NO: 28805 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactctacaagatggaaaggttcagagactttatggtttggctactgttgctaa

SEQ ID NO: 28806 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 28807 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28808 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28809 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28810 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaaccagttatgttggaccgaatgttgcgtctcttggcttgttacaatatcctcacttgttcagttcgtactcaacaagatggaaagattcagagactttatggtttggctactgttgctaa

SEQ ID NO: 28811 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaaccagttatgttggaccgaatgttgcgtctcttggcttgttacaatatcctcacttgttcagttcgtactcaacaagatggaaaggttcagagactttatggtttggctactgttgctaa

SEQ ID NO: 28812 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 28813 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaaatgcaccagttatgttggaccgaatgttgcgtctcttggcttgttacaatatcctcacttgttctgttcgtactcaacaagatggaaagattcagagactttatggtttggctactgttgctaa

SEQ ID NO: 28814 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28815 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28816 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 28817 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28818 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28819 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28820 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28821 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28822 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 28823 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 28824 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28825 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28826 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctccagttatgttggaccgaatgttgcgtctcttggcttgttacaatatcctcacttgttcagttcgtactcaacaagatggaaagattcagagactttatggtttggctactgttgctaa

SEQ ID NO: 28827 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctccagttatgttggaccgaatgttgcgtctcttggcttgttacaatatcctcacttgttcagttcgtactcaacaagatggaaaggttcagagactttatggtttggctactgttgctaa

SEQ ID NO: 28828 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctccagttatgttggaccgaatgttgcgtctcttggcttgttacaatatcctcacttgttcagttcgtactcaacaagatggaaaagttcagagactttatggtttggctactgttgctaa

SEQ ID NO: 28829 - DNA, 300 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcatcctcacttgttcagttcgtactcaacaagatggaaagattcagagactttatggtttggctactgttgctaa

SEQ ID NO: 28830 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcatcctcacttgttcagttcgtactcaacaagatggaaaagttcagagactttatggttggctactgttgctaa

SEQ ID NO: 28831 - DNA, 300 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcatcctcacttgttcagttcgtactcaacaagatggaaaagttcagagactttatggtttggctactgttgctaa

SEQ ID NO: 28832 - DNA, 300 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcatcctcacttgttcagttcgtactcaacaagatggaaaggttcagagactttatggtttggctactgttgctaa

SEQ ID NO: 28833 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgttggaccgaatgttgcgtctcttggtttgttacaatatcctcacttgttcagttcgtactcaacaagatggaaaagttcagagactttatggtttggctactgttgctaa

SEQ ID NO: 28834 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgttggaccgaatgttgcgtctcttggcttgttacaatatcctcacttgttcagttcgtactcaacaagatggaaaggttcagagactttatggtttggctactgttgctaa

SEQ ID NO: 28835 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgttggaccgaatgttgcgtctcttggcttgttacaatatcctcacttgttcagttcgtactcaacaagatggaaagattcagagactttatggtttggctactgttgctaa

SEQ ID NO: 28836 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgcaccagttatgttgggccgaatgttgcgtctcttggcttgttacaatatcctcacttgttcagttcgtactcaacaagatggaaaggttcagagactttatggtttggctactgttgctaa

SEQ ID NO: 28837 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28838 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28839 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaagattcagagactttatggtttggctactgttgctaa

SEQ ID NO: 28840 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28841 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggagaggttcagagactttatggtttggctactgttgctaa

SEQ ID NO: 28842 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28843 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28844 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28845 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 28846 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgatgcaccagttatgttggaccgaatgttgcgtctcttggcttgttacaatatcctcacttgttcagttcgtactcaacaagatgaaaaggttcagagactttatggtttggctactgttgctaa

SEQ ID NO: 28847 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28848 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatcaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28849 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28850 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28851 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctactaacaccagttatgttggaccgaatgttgcgtctcttggcttgttacaatatcctcacttgttcagttcgtactcaacaagatggaaaagttcagagactttatggtttggctactgttgctaa

SEQ ID NO: 28852 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctactaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28853 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacgaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28854 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgtttgaccgaatgttgcgtctcttggcttgttacaatatcctcacttgttcagttcgtactcaacaagatggaaaggttcagagactttatggtttggctactgttgctaa

SEQ ID NO: 28855 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28856 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28857 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28858 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28859 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagcctttatggtttggcgactgttgctaa

SEQ ID NO: 28860 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 28861 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttacgtctcttggcttgttacaatatcctcacttgttcagttcgtactcaacaagatggaaaggttcagagactttatggtttggctactgttgctaa

SEQ ID NO: 28862 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28863 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaaggttgcgtctcttggcatgttacaatatcctcacttgttcagttcgtactcaacaagatggaaaggttcagagacttaatggtttggctactgttgctaa

SEQ ID NO: 28864 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctcctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 28865 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28866 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28867 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctcctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 28868 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctcctgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 28869 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28870 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28871 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28872 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28873 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28874 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28875 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgacaattatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28876 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgacaactaaccaccagttatgttggaccgaatgttgcgtctcttggcttgttacaatatcctcacttgtgcagttcgtactcaacaagatggaaaagttcagagactttatggtttggctactgttgctaa

SEQ ID NO: 28877 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgacaaccaacgagtggtggaaggtgtacccctccagcgtgaccgagttcaagttcctgttcgtgtccggccacttcaagggcaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28878 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28879 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28880 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaaagttcagagactttatggtttggctactgttgcgaa

SEQ ID NO: 28881 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28882 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 28883 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28884 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccctgatgcaccagttatgctggaccgaatgttgcgtctcttggcttgttacaatatcctcacttgttcagttcgtactcaacaagatggaaagattcagagactttatggtttggctactgttctaa

SEQ ID NO: 28885 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccctatgcaccagttatgttggaccgaatgttgcgtctcttggcttgttacaatatcctcacttgttcagttcgtactcaacaagatggaaagattcagagactttatggtttggctactgttgctaa

SEQ ID NO: 28886 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccctatgcaccagttatgttggaccgaatgttgcgtctcttggcttgttacaatatcctcacttgttcagttcgtactcaacaagatggaaaggttcagagactttatggtctgctactgttgctaa

SEQ ID NO: 28887 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28888 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccctatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28889 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28890 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28891 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaagattcagagactttatggtttggctactgttgctaa

SEQ ID NO: 28892 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28893 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28894 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaggttcagagactgtatggtttggctactgtggctaa

SEQ ID NO: 28895 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 28896 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28897 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28898 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28899 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28900 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgatgcaccagttatgttggaccgaatgttgcgtctcttggcttgttacaatatcctcacttgttcagttcgtactcaacaagatggaagattcagagactttatggtttggctactgttgctaa

SEQ ID NO: 28901 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatcaactgatgcaccagttatgtttgaccgaatgttgcgtctcttggcttgttacaatatcctcacttgttcagttcgtactcaacaagatggaaaggttcagagactttatggtttggctactgttgcta

SEQ ID NO: 28902 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatcaacctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 28903 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatcaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 28904 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccagttatgttggaccgaatgttgcgtctcttggcttgttacaatatcctcacttgttcagttcgtactcaacaagatggaaaggttcagagactttatggtttggctactgttgctaa

SEQ ID NO: 28905 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccagttatgttggaccgaatgttgcgtctcttggcttgttgcaatatcctcacttgttcagttcgtactcaacaagatggaaaggttcagagactttatggtttggctactgttgctaa

SEQ ID NO: 28906 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccagttatgttggaccgaatgttgcgtctcttggcttgttacaatatcctcacttgttcagttcgtactcaacaagatggaaagattcagagactttatggtttggctactgttgctaa

SEQ ID NO: 28907 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccagttatgttggaccgaatgttgcgtctcttggctggttacaatatcctcacttgtcagttcgtactcaacaagatggaaaggttcagagactttatggtttggctactgttgctaa

SEQ ID NO: 28908 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccagcaatgcaccagttatgttggaccgaatgttgcgtctcttggcttgttacaatatcctcacttgttcagttcgtactcaacaagagggaaaggttcagagactttatggttgggctactgttgctaa

SEQ ID NO: 28909 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccagcaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28910 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccagcaactaacctgatgcaccagttatgttggaccgaatgttgcgtctcttggcttgttacaatatcctcatttgttcagttcgtactcaacaagatggaaaggttcagagactttatggttgggctactgttgctaa

SEQ ID NO: 28911 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccagcaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28912 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28913 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28914 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28915 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 28916 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 28917 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28918 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaacgttcagagactttatggtttggctactgtgctaa

SEQ ID NO: 28919 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaggttcagagactttatggtttggctactgttgcta

SEQ ID NO: 28920 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccactgatgcaccagttatgttgaaccgaattttgcgtctcgtggcttgttacaatatcctcacttgttcagttcgtactcaacaagatggaaaggttcagagactttatggtttggctactgttgctaa

SEQ ID NO: 28921 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28922 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28923 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccacctgatgcaccagttatgttggaccgattgttgcgtctcttggcttgttacaatatcctcacttgttcagttcgtactcaacaagatggaaaagttcagagactttatggtttggctactgttgctaa

SEQ ID NO: 28924 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaccgaatgttgcgtctcttggcttgttacaatatcctcacttgttcagttcgtactcaacaagatggaaaggttcagagactttatggtttggctactgttgctaa

SEQ ID NO: 28925 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaccgaatgttgcgtctcttggcttgttacaatatcctcacttgttcagttcgtactcaacaagatggaaagattcagagactttatggtttggctactgttgctaa

SEQ ID NO: 28926 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaccgaatgttgcgtctcttggcttgttacaatatcctcacttgtgcagttcgtactcaacaagatggaaagattcagagactttatggtttggctactgttgctaa

SEQ ID NO: 28927 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaccgaatgttgcgtctcttggcttgttacaatatcctcacttgttcagtccgtactcaacaagatggaaaggttcagagactttatgttttggctactgttgctaa

SEQ ID NO: 28928 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaccgaatgttgcgtctcttggcttgttacaatatcctcacttgttcagttcgtactcaacaagatggaaaggttcagagactttatggtttggcgactgttgctaa

SEQ ID NO: 28929 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaccgaatgttgcgtctcttggcttgttacaatatcctcacttgttcagttcgtactcaacaagatggaaaagttcagagactttatggtttggctactgttgctaa

SEQ ID NO: 28930 - DNA, 330 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgttgtgtctcttggcttgctacaatatcctcacttgttcagttcgtactcaacaagatggaaaggttcagagactttatggtttggctactgttgctaa

SEQ ID NO: 28931 - DNA, 330 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgttgcgtctcttggcttgttacaatatcctcacttgttcagttcgtactcaacaagatggaaaagttcagagactttatggtttggctactgttgctaa

SEQ ID NO: 28932 - DNA, 330 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgttgcgtctcttggcttgttacaatatcctcacttgttcagttcgtactcaacaagatggaaagattcagagactttatggtttggctactgttgctaa

SEQ ID NO: 28933 - DNA, 330 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgttgcgtctcttggcttgttacaatatcctcacttgttcagttcgtactcaacaagatggaaaggttcagagactttatggtttggctactgttgctaa

SEQ ID NO: 28934 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgcaccagttatgtttgaccgaatgttgcgtctcttggcttgttacaatatcctcacttgttcagttcgtactcaacaagatggaaaggttcagagactttatggtttggctactgttgctaa

SEQ ID NO: 28935 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 28936 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28937 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28938 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28939 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28940 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28941 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28942 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28943 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 28944 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatatgcaccagttatgttggaccgaatgttgcgtctcttggcttgttacaatatcctcacttgttcagttcgtactcaacaagatggaaaggttcagagactttatggtttggctatgttgctaa

SEQ ID NO: 28945 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28946 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaataaccctgatgcaccagttatgttggaccgaatgttgcgtctcttggcttgttataatatcctcacttgttcagttcgtactcaacaagatggaaaggttcagagactttatggtttggctactgttgctaa

SEQ ID NO: 28947 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaataaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28948 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaataaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28949 - DNA, 413 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaagtcaagccgtgggcctggcacagccccggcaacagccgctggaccgtctccagcgcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28950 - DNA, 413 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaagtcaagccgtgggcctggcacagcaccggcaacagccgctggaccgtctccagcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28951 - DNA, 413 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaagtcaagccgtgggcctggcacagcaccggcaacagccgctggaccgtctccagcgcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28952 - DNA, 413 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaagtcaagccgtgggcctggcacagcaccggcagcagccgctggaccgtctccagcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28953 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28954 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 28955 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28956 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28957 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaagatgcaccagttatgttgcaccgaatgttgcgtctcttggcttgttacaatatcctcacttgttcagttcgtactcaacaagatggaaaggttcagagactttatggtttggctactgttgctaa

SEQ ID NO: 28958 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaagatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 28959 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaagaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28960 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28961 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcgccagttatgttggaccgaatgttgcgtctcttggcttgttacaatatcctcacttgttcagttcgtactcaacaagatggaaagattcagagactttatggtttggctactgttgctaa

SEQ ID NO: 28962 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28963 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28964 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 28965 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgtggcgtctcttggcttgttacaatatcctcacttgttcagttcgtactcaacaagatggaaagattcagagactttatggtttggctactgttgctaa

SEQ ID NO: 28966 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcttcacttgttcagttcgtactcaacaagatggaaaggttcagagactttatggtttggctactgttgctaa

SEQ ID NO: 28967 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatggtgcgtctcttggcttgttacaataacctcacttgttcagttcgtactcaactagatggaaaggttcagagactttatggtttggctactgttgctaa

SEQ ID NO: 28968 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgcta

SEQ ID NO: 28969 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 28970 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaagattcagagactttatgggttggctactgttgctaa

SEQ ID NO: 28971 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttgggctactgttgctaa

SEQ ID NO: 28972 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgctcagttcgtactcaacaagatggaaaggttcagagactttatggtttggctactgttgctaa

SEQ ID NO: 28973 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 28974 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 28975 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagattgaaaagttcagagactttatggtttggctactgttgctaa

SEQ ID NO: 28976 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28977 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 28978 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgactcttggcttgttacaatatcctcacttgttcagttcgtactcaacaagatggaaaggttcagagactttatggtttggctactgttgataa

SEQ ID NO: 28979 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgtgtctcttggcttgttacaatatcctcacttgttcagttcgtactcaacaagatggaaaagttcagagactttatggtttggctactgttgctaa

SEQ ID NO: 28980 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatgtaaaggttcagagactttatggtttggctactgttgctaa

SEQ ID NO: 28981 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaagttcagagactttatggtttggtactgttgctaa

SEQ ID NO: 28982 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactatatggtttggctactgttgctaa

SEQ ID NO: 28983 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcaggtcgtactcaacaagatggaaaggttcagagactttatggtttggctactgttgctaa

SEQ ID NO: 28984 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgtgtctcttggcttgttacaatatcctcacttgttcagttcgtactcaacaagatggaaagattcagagactttatggtttggctactgttgctaa

SEQ ID NO: 28985 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaacgaatgttgcgtctcttggcttgttacaatatcctcacttgttcagttcgtactcaacaagatggaaaggttcagagactttatggtttggctactgttgctaa

SEQ ID NO: 28986 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatattggaccgaatgttgcgtctcttggcttgttacaatatcctcacttgttcagttcgtactcaaaaagatggaaaggttcagagactttatggtttggctactgttgctaa

SEQ ID NO: 28987 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 28988 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 28989 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 28990 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28991 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 28992 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactctgatgcaccagttatgttggaccgaatgttgcgtctcttggcttgttacaatatcctcacttgttcagttcgtactcaacaagatggaaaggttcagagactttatgggttggctactgttgctaac

SEQ ID NO: 28993 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactctgatgcaccagttatgttggaccgaatgttgcgtctcttggcttgttacaatatcctcacttgttcagttcgtactcaacaagatggaaaggttcagagtctttatggtttggctactgttgctaa

SEQ ID NO: 28994 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 28995 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 28996 - DNA, 342 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgttggaccgaatgttgcgtctcttggcttgttacaatatcctcacttgttcagttcgtactcaacaagatggaaaggttcagagactttatggtttggctactgttgctaa

SEQ ID NO: 28997 - DNA, 342 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgttggaccgaatgttgcgtctcttggcttgttacaatatcctcacttgttcagttcgtactcaacaagatggaaaggttcagagactttatggtttggctactgttgctag

SEQ ID NO: 28998 - DNA, 342 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgttggaccgaatgttgcgtctcttggcttgttacaatatcctcacttgttcagtttgtactcaacaagatggaaaggttcagagactttatggtttggctactgttgctaa

SEQ ID NO: 28999 - DNA, 342 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgttggaccgaatgttgcgtctcttggcttgttacaatatcctcacttgttcagttcgtactcaacaagatggaaagattcagagactttatggtttggctactgttgctaa

SEQ ID NO: 29000 - DNA, 342 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgttggaccgaatgttgcgtctcttggcttgttacaatatcctcacttgttcagttcgtactcaacaagatggaaaagttcagagactttatggtttggctactgttgctaa

SEQ ID NO: 29001 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 29002 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgcaccagttatgttggaccgaatgttgcgtctcttggcttgttacaatatcctcacttgttcagttcgtactcaacaagatggaaagattcagagactttatggtttggctactgttgctaa

SEQ ID NO: 29003 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgcaccagttatgttggaccgaatgttgcgtctcttggcttgttacaatatcctcacttgttcagttcgtactcaacaagatggaaaggttcagagactttatggtttggtactgttgctaa

SEQ ID NO: 29004 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgcaccagttatgttggaccgaatgttgcgtctcttggcttgttacaatatcctcacttgttcagttcgtactcaacaagatggaaaagttcagagactttatggtttggctactgttgctaa

SEQ ID NO: 29005 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacgatatccagacatgttcagttcgtactcaacaaggtggaaaggttcagagactgtatggattggcgactgatgctaa

SEQ ID NO: 29006 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29007 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttctgttcgtactcaacaaggtggaaaggttcagagactttatggtttggctactgttgctaa

SEQ ID NO: 29008 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29009 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29010 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatgggaagattcagagactttatggtttggctactgttgctaa

SEQ ID NO: 29011 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttgaaccgaattttgcgtatcttggcttgattcaatatcctcacttcttcagttcgtactcaacaagatgcaaaggttcccagacattatggtttggtgactgttgcgaa

SEQ ID NO: 29012 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 29013 - DNA, 404 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgactgggcctttcgttttatctgttgtctgtcggtgaacgctctccctgatgcaccagttatgtgggaccgaatgttgcgtctcttggcttgttacaatatcctcacttgttcagttcgtactcaacaagatggaaaagttcagagactttatggtttggctactgttgctaa

SEQ ID NO: 29014 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgaccgaatgttgcgtctcttgtcttgttacaatatcctcacttgttcagttcgtactcaacaagatggaaaggttcagagactttatggtttggctactgttgctaa

SEQ ID NO: 29015 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgaccgaatgttgcgtctcttggcttgttacaatatcctcacttgttcagttcgtactcaacaagatggaaaggttcagagactttatggtttggctactgttgctaa

SEQ ID NO: 29016 - DNA, 337 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgaccgaatgttgcgtctcttggcttgttacaatatcctcacttgttcagttcgtactcaacaagatggaaaggttcagagactttatggtttggctatgttgctaa

SEQ ID NO: 29017 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgaccgaatgttgcgtctcttggcttgttacaatatcctcacttgttcagttcgtactcaacaagatggaaagattcagagactttatggtttggctactgttgctaa

SEQ ID NO: 29018 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgaccgaatgttgcgtctcttggcttgttacaatatcctcacttgttcagttcgtactcaacaagatggaaaggttcagagactttatggtttggcgactgttgctaa

SEQ ID NO: 29019 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgaccgaatgttgcgtctcttggcttgttacaatatcctcacttgttctgttcgtactcaacaagatggaaaggttcagagactttatggtttggctactgttgctaa

SEQ ID NO: 29020 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttgtatcgaagttggcgtctcttggcttgttacaatagcctcccttgttcagtgcgtactcaacaagatggataggttcagagactttatggtttggcgactggtgctga

SEQ ID NO: 29021 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttgtaccgaatgttgcgtctcttggcttgttacaatatcctcacttgttcagttcgtactcaacaatatggaaagattcagagactttatggtttggctactgttgctaa

SEQ ID NO: 29022 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 29023 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29024 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29025 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29026 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 29027 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggtacagagactttatggtttggctactgttgctaa

SEQ ID NO: 29028 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29029 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29030 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatcgtttggctactgttgctaa

SEQ ID NO: 29031 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggagaggttcagagactttatggtttggctactgttgctaa

SEQ ID NO: 29032 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 29033 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 29034 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgtttgctaa

SEQ ID NO: 29035 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 29036 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 29037 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccgtcaaccagccgctggaccgtctccagccccttctgccgtttctgtgctggctattcccaccaccccttatgcaccagttatgttgtaccgaattttgcgtctcttggcttgttacaatatcctcacttgttcagttcgtactcaacaagattgaaacattcagacactttatggtttgtctactgttactag

SEQ ID NO: 29038 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccggcaagcaggcgctggagacggcccagcgcctgctgccggtgctgtgctggcgatggccaccacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29039 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccggcaagcagccgctggaccgtctccagcgcctgctgccggtgctgtgctggcgatggccaccacccctgatgcaccagttatgttggaccgaatgttgcgtctcttggcttgttacaatatcctcacttgttcagttcgtactcaacaagatggacaggttcagagactttatggtttggctactgttgctaa

SEQ ID NO: 29040 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccggcaagcagccgctggaccgtctccagcgcctgctgccggtgctgtgctggcgatggccaccacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29041 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccggcaagcagccgctggaccgtctccagcgcctgctgccggtgctgtgctggcgatggccaccacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29042 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 29043 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29044 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 29045 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29046 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaagattcagagactttatggtttggctactgttgcaa

SEQ ID NO: 29047 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcgtggcttgttacaatatcctcacttgttcagttcgtactcaacaagatggaaagattcagagactttatggtttggctactgttgctaa

SEQ ID NO: 29048 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29049 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgtccagttcgtactcaacaagatggaaaggttcagagactttatggtttggctactgttgctaa

SEQ ID NO: 29050 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 29051 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29052 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcctgttaaaatatcctcacttgttcagttcgtactcaacaagacggaaaggttcagagactttatggtttggctactgttgctaa

SEQ ID NO: 29053 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 29054 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatattggaccgaatgttgcgtctcttggcttgttacaatatcctcacttgttcagttcgtactcaacaagatggaaaggttcagagactttatggtttggctactgttgctaa

SEQ ID NO: 29055 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccactaaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29056 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatttatgttggaccgaatgttgcgtctcttggcttgttacaatatcctcacttgttcagttcgtactcaacaagatggaaaggttcagagactttatggtttgctactgttgctaa

SEQ ID NO: 29057 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttgggccgaatgttgcgtctcttggcttgttacaatatcctcacttgttcagttcgtactcaacaagatggaaagattcagagactttatggtttggctactgttgctaa

SEQ ID NO: 29058 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29059 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29060 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 29061 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaagattcagagactttatggtttggctatgttgctaa

SEQ ID NO: 29062 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttgctactgttgctaa

SEQ ID NO: 29063 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgtaa

SEQ ID NO: 29064 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29065 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctaccgttgctaa

SEQ ID NO: 29066 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcatggcttgttacaatatcctcacttgttcagttcgtactcaacaagatggaaaggttcagagactttatggtttggctactgttgctaa

SEQ ID NO: 29067 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29068 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctctttgcttgtaacaatatcctcacttgttcagttcgtactcaacaagatggaaaggttcagagactttatggtttggctactgttgctaa

SEQ ID NO: 29069 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaataccctcacttgttcagttcgtactcaacaagatggaaaagttcagagactttatggtttggctactgttgctaa

SEQ ID NO: 29070 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgtgcagttcgtactcaacaagatggaaaggttcagagactttatggtttggctatgttgctaa

SEQ ID NO: 29071 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctatgttgctaa

SEQ ID NO: 29072 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgtttaa

SEQ ID NO: 29073 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagacttatggtttggctactgttgctaa

SEQ ID NO: 29074 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 29075 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggatcgaatgttgcgtctcttggcttgttacaatatcctcacttgttcagttcgtactcaacaagatggaaagattcagagactttatggtttggctactgttgctaa

SEQ ID NO: 29076 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29077 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29078 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29079 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 29080 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgcta

SEQ ID NO: 29081 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcggagactttatggtttggctactgttgctaa

SEQ ID NO: 29082 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29083 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 29084 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttactaa

SEQ ID NO: 29085 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctgttgctaa

SEQ ID NO: 29086 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatcttggaccgaatgttgcgtctcttggcttgttacaatatcctcacttgttcagttcgtactcaacaagatggaaagattcagagactttatggtttggctactgttgctaa

SEQ ID NO: 29087 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29088 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29089 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29090 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29091 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29092 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatcagttatgttggaccgaatgttgcgtctcttggcttgttacaatatcctcacttgttcagttcgtactcaacaagatggaaaagttcagagactttatggtttggctactgttgctaa

SEQ ID NO: 29093 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatcagttatgttggaccgaatgttgcgtctcttggcttgttacaatatcctcacttgttcagttcgtactcaacaagatggaaaagttcagagcctttatggtttggctactgttgctaa

SEQ ID NO: 29094 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatcagttatgttggaccgaatgttgcgtctcttggcttgttacaatatcctcacttgttcagttcgtactcaacaagatggaaagattcagagactttatggtttggctactgttgctaa

SEQ ID NO: 29095 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatcagttatgttggaccgaatgttgcgtctcttggcttgttacaatatcctcacttgttcagttcgtactcaacaagatggaaaagttcagagactttatggtttggctactgtgctaa

SEQ ID NO: 29096 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatcagttatgttggaccgaatgttgcgtctcttggcttgttacaatatcctcacttgttcagttcgtactcaacaagatggaaaggttcagagactttatggtttggctactgttgctaa

SEQ ID NO: 29097 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29098 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatacaccagttatgttggaccgaatgttgcgtctcttggcttgttacaatatcctcacttgttcagttcgtactcaacaagatggaaaggttcagagactttatggtttggctactgttgctaa

SEQ ID NO: 29099 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagttatgttggaccgaatgttgcgtctcttggcttgttacaatatcctcacttgttcagttcgtactcaacaagatggaaaggttcagagactttatggtttggctactgttgctaa

SEQ ID NO: 29100 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagttatgttggaccgaatgttgcgtctcttggcttgttacaatatcctcacttgttcagttcgtactcaacaagatggaaagattcagagactttatggtttggctactgttgctaa

SEQ ID NO: 29101 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaggagcaggtggtggccatcgccagcaatattggtggcaagcaggcgctggagacggtgcaggcgctgttgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29102 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaggagcaggtggtggccatcgccagcaataatggtggcaagcaggcgctggagacggtccagcggctgttgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29103 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaggagcaggtggtggccatcgccagcaatattggtggcaagcaggcgctggagacggtgcaggcgctgttgccctgatgcaccagttatgttggaccgaatgttgcgtctcttggcttgttacaatatcctcacttgttcagttcgtactcagcaagatggaaagattcagagactttatggtttggctactgttgctaa

SEQ ID NO: 29104 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaggagcaggtggtggccatcgccagcaatattggtggcaagcaggcgctggagacggtgcaggcgctgttgccctgatgcaccagttatgttggaccgaatgttgcgtctcttggcttgttacaatatcctcacttgttcagttcgtactcaacaagatgtaaaagttcagagactttatggtttggctactgttgctaa

SEQ ID NO: 29105 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaggagcaggtggtggccatcgccagcaataatggtggcaagcaggcgctggagacggtccagcggctgttgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29106 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaggagcaggtggtggccatcgccagcaataatggtggcaagcaggcgctggagacggtccagcggctgttgccctgatgcaccagttatgttggaccgaatgatgcgtctcttggcttgttacaatatcctcacttgttcagttcgtactcaacaagatggaaaagttcagagactttatggtttggctactgttgctaa

SEQ ID NO: 29107 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaggagcaggtggtggccatcgccagcactaatggtggcaagcaggcgctggagacggtccggcggctgttgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29108 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29109 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29110 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 29111 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29112 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaaaatggaaagattcagagactttatggtttggctactattgctaa

SEQ ID NO: 29113 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaagttcagagactttatggtttggctactgttgcta

SEQ ID NO: 29114 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29115 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcctggcttgttacaatatcctcacttgttcagttcgtactcaacaagatggaaagattcagagactttatggtttggctactgttgctaa

SEQ ID NO: 29116 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgtgctaa

SEQ ID NO: 29117 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaagtttccgcgactttatggtttggctactgttgctaa

SEQ ID NO: 29118 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtcctcaacaagatggaaaggttcagagtctttatggtttggctactgttgctaa

SEQ ID NO: 29119 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaagattcagagcctttatggtttggctactgttgctaa

SEQ ID NO: 29120 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagtctttatggtttggctactgttgctaa

SEQ ID NO: 29121 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaacgttgcgtctcttggcttgttacaatatcctcacttgttcagttcgtactcaacaagatggaaaagttcagagactttatggtttggctactgttgctaa

SEQ ID NO: 29122 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagtcatgttggaccgaatgttgcgtctcttggcttgttacaatatcctcacttgttctgttcgtactcaacaagatggaaagattcagagactttatggtttggctactgttgctaa

SEQ ID NO: 29123 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29124 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29125 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 29126 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29127 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttctaa

SEQ ID NO: 29128 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcatctcttggcttgttacaatatcctcacttgttcagttcgtactcaacaagatggaaaggttcagagactttatggtttggctactgttgctaa

SEQ ID NO: 29129 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatgtcctcacttgttcagttcgtactcaacaagatggaaagattcagagactttatggtttggctactgttgctaa

SEQ ID NO: 29130 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29131 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgctcagttcgtactcaacaagatggaaaggttcagagactttatggtttggctactgttgctaa

SEQ ID NO: 29132 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtcgcttggcttgttacaatatcctcacttgttcagttcgtactcaaccagatggaaaagttcaaagactttatagtttggctactgtggctaa

SEQ ID NO: 29133 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 29134 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcggttcgtactcaacaagatggaaaggttcagagactttatggtttggctactgttgctaa

SEQ ID NO: 29135 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaagtttagagactttatggtttggctactgttgctaa

SEQ ID NO: 29136 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 29137 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtctggctactgttgctaa

SEQ ID NO: 29138 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaagattcagagactttatggtttggctctgttgctaa

SEQ ID NO: 29139 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatattggaccgaatgttgcgtctcttggcttgttacaatatcctcacttgttcagttcgtactcaacaagatggaaaggttcagagactttatggtttggctactgttgctaa

SEQ ID NO: 29140 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagtcatgttggaccgaatgttgcgtctcctggcttgttacaatatcctcacttgttcagttcgtactcaacaagatggaaaggttcagagactttatggtttggctactgttgctaa

SEQ ID NO: 29141 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactaatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29142 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacgcaccagttatgttggaccgaatgttgcgtctcttggcttgttacaatatcctcacttgttcagttcgtactcaacaagatggaaaggttcagagactttatggtttggctactgttgctaa

SEQ ID NO: 29143 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacgcaccagttatgttggaccgaatgttgcgtctcttggcttgttacaatatcctcacttgttcagttcgtactcaacaagatggaaagattcagagactttatggtttggctactgttgctaa

SEQ ID NO: 29144 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacgcaccagttatgttggaccgaatgttgcgtctcttggcttgttacaatatcctcacttgttcagttcgtactcaacaagatggaaaagttcagagactttatggtttggctactgttgctaa

SEQ ID NO: 29145 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29146 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29147 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29148 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 29149 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29150 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29151 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttctgttcgtactcaacaagatggaaaggttcagagactctatggtttggctactgttgctaa

SEQ ID NO: 29152 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatccgcacttgttcagttcgtactcaacaagatggaaaggttcagagactgtatggtttggctactgttgctaa

SEQ ID NO: 29153 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29154 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29155 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccccagcaggtggtggccatcgccagcaatggcggtggcaagcaggcgctggagacggtccagcggctgttgccggtgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29156 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 29157 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatcgaaaagttcagagactttatggtttggctactgttgctaa

SEQ ID NO: 29158 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaagattcagagactttatggtttggctactgttgctaa

SEQ ID NO: 29159 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaagttcagagactttatggtttggctactgttgctaa

SEQ ID NO: 29160 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgcaa

SEQ ID NO: 29161 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttctgttcgtactcaacaagatggaaaggttcagagactttatggtttggctactgttgctaa

SEQ ID NO: 29162 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaagttcagagactttatggtttggctactgtttctaa

SEQ ID NO: 29163 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactattgctaa

SEQ ID NO: 29164 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttctgttcgtactcaacaagatggaaagattcagagactttatggtttggctactgttgctaa

SEQ ID NO: 29165 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctacgttgctaa

SEQ ID NO: 29166 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttctgttcgtactcaacaagatggaaaggttcagagactttatggtttggctactgttgcta

SEQ ID NO: 29167 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttctgttcgtactcaacaagatggaaaggttcagagactttatggtttggcactgttgctaa

SEQ ID NO: 29168 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatttatgttggaccgaatgttgcgtctcttggcttgttacaatatcctcacttgttcagttcgtactcaacaagatggaaaagttcagagactttatggtttggctactgttgctaa

SEQ ID NO: 29169 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaattgcaccagttatgttggaccgaatgttgcgtctcttggcttgttacaatatcctcacttgttcagttcgtactcaacaagatggaaaggttcagagactttatggtttggctactgttgctaa

SEQ ID NO: 29170 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaattatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29171 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaattatgcaccagttatgttggaccgaatgttgcgtctcttggcttgttacaatatcctcacttgttcagttcgtactcaacaagatggaaagattcagagactttatggtttggctactgttgctaa

SEQ ID NO: 29172 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaattatgcaccagttatgttggaccgaatgttgcgtctcttggcttgttacaatatcctcacttgttcagttcgtactcaacaagatggaaagagtcagagactttatggtttggctactgttgctaa

SEQ ID NO: 29173 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaattatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29174 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggacctaatgttgcgtctcttggcttgttacaatatcctcacttgttcagttcgtactcaacaagatggaaaggttcagagactttatggtttggctactgttgctaa

SEQ ID NO: 29175 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 29176 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29177 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29178 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29179 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagacggaaaggttcagagactttatggtttggctactgttgctaa

SEQ ID NO: 29180 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctctttgcttgttacaatatcctcacttgttcagttcgtactcaacaagatggaaaggttcagagactttatggtttggctactgttgctaa

SEQ ID NO: 29181 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 29182 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggttggctactgttgctaa

SEQ ID NO: 29183 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttattcagttcgtactcaacaagatggaaaagttcagagactttatggtttggctactgttgctaa

SEQ ID NO: 29184 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaagattcagagactttattgtttggctactgttgctaa

SEQ ID NO: 29185 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcatttgttcagttcgtactcaacaagatggaaaggttcagagactttatggtttggctactgttgctaa

SEQ ID NO: 29186 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgtgtctcttggcttgttacaatatcctcacttgttcagttcgtactcaacaagatggaaaggttcagagactttatggtttggctactgttgctaa

SEQ ID NO: 29187 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29188 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgtgcagttcgtactcaacaagatggaaaagttcagagactttatggtttggctactgtagcaa

SEQ ID NO: 29189 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaagattcagagcctttatggtttggctactgttgctaa

SEQ ID NO: 29190 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacacgatggaaaggttcagagactttatggtttggctactgttgc

SEQ ID NO: 29191 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttgctactgttgctaa

SEQ ID NO: 29192 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatgtcctcacttgttcagttcgtactcaacaagatggaaaggttcagagactatatggtttggctactgttgctaa

SEQ ID NO: 29193 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgtttgctaa

SEQ ID NO: 29194 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 29195 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 29196 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29197 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29198 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29199 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatagaaaagttcagagactttatggtttggctactgttgctaa

SEQ ID NO: 29200 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacgagatggaaaggttcagagactttatggtttggctactgttgctaa

SEQ ID NO: 29201 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29202 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcaaagactttatggtttggctactgttgctaa

SEQ ID NO: 29203 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagagggaaaggttcagagactttatggtttggctactgttgctaa

SEQ ID NO: 29204 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtcctcaacaagatggaaaggttcagagactttatggtttggctactgttgctaa

SEQ ID NO: 29205 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29206 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgattgttgcgtctcttggcttgttacaatatcctcacttgttcagttcgtactcaacaagatggaaaagttcagagactttatggtttggctactgttgctaa

SEQ ID NO: 29207 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttctaa

SEQ ID NO: 29208 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 29209 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcactttttcagttcgtactcaacaagatggaaaagttcagagactttatggtttggctactgttgctaa

SEQ ID NO: 29210 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgcactcaacaagatggaaaggttcagagactttatggtttggctactgttgctaa

SEQ ID NO: 29211 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagttggaaaggttcagagactttatggtttggctactgttgctaa

SEQ ID NO: 29212 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcccttgttcagttcgtactcaacaagatggaaagattcagagactttatggtttggctactgttgctaa

SEQ ID NO: 29213 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcggttcgtactcaacaagatggaaaagttcagagactttatggtttggctactgttgctaa

SEQ ID NO: 29214 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttgaaccgaatgttgcgtctcttggcttgttacaatatcctcacttgttcagttcgtactcaacaagatggaaagattcagagactttatggtttggctactgttgctaa

SEQ ID NO: 29215 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 29216 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagtcatgttggaccgaatgttgcgtctcttggcttgttacaatatcctcactttttctgttcgtactcaacaagatggaaaggttcagagactttatggtttggctactgttgctaa

SEQ ID NO: 29217 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 29218 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29219 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29220 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29221 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaaggttcagagactttatggtttggctactgtggctaa

SEQ ID NO: 29222 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacgtgttcagttcgtactcaacaagatggaaaggttcagagactttatggtttggctactgtt

SEQ ID NO: 29223 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatccccacttgttcagttcgtactcaacaagatggaaaggttcagagactttatggtttggctactgttgctaa

SEQ ID NO: 29224 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 29225 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggacagaatgttgcgtctcttggcttgttacaatatcctcacttgttcagttcgtactcaacaagatggaaaagttcagagcctttatggtttggctactgttgctaa

SEQ ID NO: 29226 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29227 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29228 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 29229 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcaaagactttatggtttggctactgttgctaa

SEQ ID NO: 29230 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgcgaa

SEQ ID NO: 29231 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactggtgctaa

SEQ ID NO: 29232 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggatactgttgctaa

SEQ ID NO: 29233 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29234 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttaagttcgtactcaacaagatggaaaggttaagagactttatggtttggctactgttgctaa

SEQ ID NO: 29235 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgatcagttcgtactcaacaagatggaaaggttcagagactttatggtttggctactgttgctaa

SEQ ID NO: 29236 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29237 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagcaccagttatgttggaccgaatgttgcgtctcttggcttgttacaatatcctcacttgttcagttcgtactcaacaagatggaaaggttcagagactttatggtttggctactgttgctaa

SEQ ID NO: 29238 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagcaccagttatgttggaccgaatgttgcgtctcttggcttgttacaatatcctcacttgttcagttcgtactcaacaagatggaaaggttcagagactttatggtttggctactgttgcta

SEQ ID NO: 29239 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagcaccagttatgttggaccgaatgttgcgtctcttggcttgttacaatatcctcacttgttcagttcgtactcaacaagatggaaagattcagagactttatggtttggctactgttgctaa

SEQ ID NO: 29240 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagcaccagttatgttggaccgaatgttgcgtctcttggcttgttacaatatcctcacttgttctgttcgtactcaacaagatggaaaggttcagagactttatggtttggctactgttgctaa

SEQ ID NO: 29241 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggatcgaatgttgcgtctcttggcttgttacaatatcctcacttgttcagttcgtactcaacaagatggaaaggttcagagactttatggtttggctactgttgctaa

SEQ ID NO: 29242 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 29243 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29244 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29245 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29246 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgataa

SEQ ID NO: 29247 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29248 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaagttcagagactttatggtttggctactgttgcta

SEQ ID NO: 29249 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatactcacttgttcagttcgtactcaacaagatggaaaggttcagagactttatggtttggctactgttgctaa

SEQ ID NO: 29250 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttgcaatatcctcacttgttcagttcgtactcaacaagatggaaaagttcagagactttatggtttggctactgttgctaa

SEQ ID NO: 29251 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttgctactgttgctaa

SEQ ID NO: 29252 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaggttcagagactttatggtttggctactgttgctaa

SEQ ID NO: 29253 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactttatgttggaccgaatgttgcgtctcttggcttgttacaatatcctcacttgttcagttcgtactcaacaagatggaaaggttcagagactttatggtttggctactgttgctaa

SEQ ID NO: 29254 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactttatgttggaccgaatgttgcgtctcttggcttgttacaatatcctcacttgttcagttcgtactcaacaagatggaaaagttcagagactttatggtttggctactgttgctaa

SEQ ID NO: 29255 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactttatgttggaccgaatgttgcgtctcttggcttgttacaatatcctcacttgttcagttcgtactcaacaagatggaaaggttcagagactttatggtttggctacggttgctaa

SEQ ID NO: 29256 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactttatgttggaccgaatgttgcgtctcttggcttgttacaatatcctcacttgttcagttcgtactcaacaagatggaaaggttcagagactttatggtttggctattgttgctaa

SEQ ID NO: 29257 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactttatgttggaccgaatgttgcgtctcttggcttgttacaatatcctcacttgttctgttcgtactcaacaagatggaaaggttcagagactttatggtttggctactgttgctaa

SEQ ID NO: 29258 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactttatgttggaccgaatgttgcgtctcttggcttgttacaatatcctcacttgttcagttcgtactcaacaagatggaaaggttcggagactttatggtttggctactggttgctaa

SEQ ID NO: 29259 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactttatgttggaccgaatgttgcgtctcttggcttgttacaatatcctcacttgttcagttcgtactcaacaagatggaaagattcagagactttatggtttggctactgttgctaa

SEQ ID NO: 29260 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcgtctcttggcttgttacaatatcctcacttgttcagttcgtactcaacaagatggaaaggttcagagactttatggtttggctactgttgctaa

SEQ ID NO: 29261 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcgtctcttggcttgttacaatatcctcacttgttcagttcgtactcaacaagatggaaaagttcggagactttatggtttggctactgttgctaa

SEQ ID NO: 29262 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcgtctcttggcttgttacaatatcctcacttgttcagttcgtactcaacaagatggaaagattcagagactttatggtttggctactgttgctaa

SEQ ID NO: 29263 - DNA, 330 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcgtctcttggcttgttacaatatcctcacttgttcagttcgtactcaacaagatggaaaggttcagagactttatggtttgctactgttgcta

SEQ ID NO: 29264 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcgtctcttggcttgttacaatatcctcacttgttctgttcgtactcaacaagatggaaaggttcagagactttatggtttggctactgttgctaa

SEQ ID NO: 29265 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcgtctcttggcttgttacaatatcctcacttgttcagttcgtactcaacaagatggaaaagttcagagactttatggtttggctactgttgctaa

SEQ ID NO: 29266 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaaggttcagagactttatggtttggctactgttgctaa

SEQ ID NO: 29267 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaagattcagagcctttatggtttggctactgttgctaa

SEQ ID NO: 29268 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcaccagttatgttggaccgaatgttgcgtctattggcttgttacaatatcctcacttgttcagttcgtactcaacaagatggaaagattcagagactttatggtttggctactgttgctaa

SEQ ID NO: 29269 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaagattcagagactttatggtttggctactgttgctaa

SEQ ID NO: 29270 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaaggttcagacactttatggtttggctactgttgctaa

SEQ ID NO: 29271 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaaggttcagagactttatggtttggcttctgttgctaa

SEQ ID NO: 29272 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaaagttcagagactttatggtttggctactgttgctaa

SEQ ID NO: 29273 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29274 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgatgcaccggttatgttggaccgaatgttgcgtctcttggcttgttacaatatcctcacttgttcagttcgtactcaacaagatggaaagattcagagactttatggtttggctactgttgctaa

SEQ ID NO: 29275 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29276 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29277 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttggctactgttgcta

SEQ ID NO: 29278 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29279 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 29280 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29281 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgatgcaccagttatgttggaccgaatgtggcgtctcttggcttgttacaatatcctcacttgttcagttcgtactcaacaagatggaaaggttcagagactatattgtttggctactgttgctaa

SEQ ID NO: 29282 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 29283 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaagttcagagactttatggtttggctactgttgctaa

SEQ ID NO: 29284 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaggttcagagactttatggtttggctactgttgctaa

SEQ ID NO: 29285 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaagttcagagactttatggtttggctactggtgctaa

SEQ ID NO: 29286 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcatactcaacaagatggaaaggttcagagactttatggtttggctactgttgctaa

SEQ ID NO: 29287 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaagattcagagactttatggtttggctactgttgctaa

SEQ ID NO: 29288 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaagttcagagcctttatggtttggctactgttgctaa

SEQ ID NO: 29289 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaggttcagagactttattgtttggatactgttgctaa

SEQ ID NO: 29290 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaggttcagagactttatggtttggctatgttgctaa

SEQ ID NO: 29291 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttctgttcgtactcaacaagatggaaaggttcagagactttatggtttggctactgttgctaa

SEQ ID NO: 29292 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttctgttcgtactcaacaagatggaaaagttcagagactttatggtttggctactgttgctaa

SEQ ID NO: 29293 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaggttcagagactttatgggttggctactgttgctaa

SEQ ID NO: 29294 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatgttggaccaaatgttgcgtctcttggcttgttacaatatcctcacttgttcagttcgtactcaacaagatggaaaagttcagagactttatggtttggctactgttgctaa

SEQ ID NO: 29295 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatcttcgagccagccacgatcgacattgatctgtgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29296 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatcttcgagccagccacgatcgacattgatctgtgatgcaccagttatgttggaccgaatgttgcgtctcttggcttgttacaatatcctcacttgttcagttcgtactcaacaagatggaaaagttcagagactttatggtttggcactgttgctaa

SEQ ID NO: 29297 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatcttcgagccagccacgatcgacattgatctgtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29298 - DNA, 421 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatcgactcaactatcagaggtagttggcgtcatcgagcgccatctcgaaccgacgttgctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29299 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatcgactcaactatcagaggtagttggcgtcatcgagcgccatctcgaaccgacgttgctggggcaccagttatgttggaccgaatgttgcgtctcttggcttgttacaatatcctcacttgttcagttcgtactcaacaagatggaaatgttcagagactttatggtttggctctgttgctaa

SEQ ID NO: 29300 - DNA, 421 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatcgactcaactatcagaggtagttggcgtcatcgagcgccatctcgaaccgacgttgctggtgcaccagttatgttggaccgaatgttgcgtctcttggcttgttacaatatcctcacttgttcagttcgtactcaacaagatggaaagattcagagactttatggtttggctactgttgctaa

SEQ ID NO: 29301 - DNA, 421 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatcgacccaactatcagaggtagttggcgtcatcgagcgccatctcgaaccgacgttgctggtgcaccagttatgttggaccgaatgttgcgtctcttggcttgttacaatatcctcacttgttctgttcgtactcaacaagatggaaaggttcagagactttatggtttggctactgttgctaa

SEQ ID NO: 29302 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgtgctggagacggtgcaggcgctgttgccggtgctgtgccaggcccacggcttgaccccccagcaggtggtggccatcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29303 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgtcaggatggccttctgcttagtttgatgcctggcagtttatggcgggcgtcctgcccgccaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29304 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgtcaggatggccttctgcttagtttgatgcctggcagtttatggcgggcgtcctgcccgccaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29305 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgtcaggatggccttctgcttagtttgatgcctggcagtttatggcgggcgtcctgcccgccaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29306 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgtcaggatggccttctgcttagtttgatgcctggcagtttatggcgggcgtcctgcccgccaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29307 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgtcaggatggccttctgcttagtttgatgcctggtagtttatggcgggcgtcctgcccgccaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29308 - DNA, 468 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactggtccagcggctgttgccaccattattggtggcgatggccaccccctgctggggggtaaagccgtgggcctggcacagcaccggcaacagccgctggaccgtctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29309 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactggtccagcgcctgcttgccaccattattgctgccgatgcccaccacctgctggggggtcaagccgtgggcctggcacagcaccggcaacagccgctggaccgtctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29310 - DNA, 404 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgggcctttcgttttatctgttgtttgtcggtgaacgctctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29311 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactggcccagcgcctgcttgccaccatgatggcgggcggtggccaccgcctgctggggggtcaagccgtgggcctggcacagcaccggcaacagccgctggaccgtctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29312 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactggcaggatggccttctgcttagtttgatgcctggcagtttatggcgggcgtcctgcccgccaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29313 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactggcacagcaccggcaacagccgctggaccgtctccagcaccagttatgttggaccgaatgttgcgtctcttggcttgttacaatatcctcacttgttcagttcgtactcaacaagatggaaaggttcagagactttatggtttggctactgttgctaa

SEQ ID NO: 29314 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactggcacagcaccggcaacagccgatggaccgtctccagcaccagttatgttggaccgaatgttgcgtctcttggcttgttacaatatcctcacttgttcagttcgtactcaacaagatggaaaagttcagagactttatggtttggctactgttgctaa

SEQ ID NO: 29315 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactggcacagcaccggcaacagccgctggaccgtctccagcaccagttatgttggaccgaatgttgcgtctcttggcttgttacaatatcctcacttgttcagttcgtactcaacaagatggaaagattcagagactttatggtttggctactgttgctaa

SEQ ID NO: 29316 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgcgctggagacggtgcaggcgctgttgccggtgctgtgccaggcccacggcttgaccccccagcaggtggtggccatcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29317 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgcgctggagacggtgcaggcgctgttgccggtgctgtgccaggcccacggcttgaccccccagcaggtggtggccatcgccctgatgcaccagtcatgttggaccgaatgttgcgtctcttggtttgttacaatatcctcacttgttcagttcgtactcaacaagatggaaagattcagagactttatggtttggctactgttgctaa

SEQ ID NO: 29318 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgcgctggagacggtgcaggcgctgttgccggtgctgtgccaggcccacggcttgaccccccagcaggtggtggccatcgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29319 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgcgctggagacggtccaggcgctgttgccggtgctgtgccaggcccacggcttgaccccccagcaggtggtggccatcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29320 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgcgctggagacggtccaggcgctgttgccggtgctgggccaggcccacggcttgaccccccagcaggtggtggccatcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29321 - DNA, 447 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgccggtgctgtgccaggcccacggcttgaccccggagcagggggtggccatcgccagcaatattggtggcaacagccgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29322 - DNA, 447 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgccggtgctgtgccaggcccacggcttgaccccggagcaggtggtggccatcgccagcaatattggtggcaacagccgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29323 - DNA, 448 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgccggtgctgtgccaggcccacggcttgaccccggagcaggtggtggccatcgccagcaatattggtggcaagcaggcgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29324 - DNA, 447 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgccggtgctgtgccaggcccacggcttgaccccggagcaggtggtggccatcgccagcaatattggtggcaccagccgctggagactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29325 - DNA, 448 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgccggtgctgtgccaggcccacggcttgaccccggagcaggtggtggccatcgccagcaatagtggtggcaagcaggcgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29326 - DNA, 447 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgccggtgctgtgccaggcccacggctggaccccggagcgggtggtggccatcgccagcaatattggtggcaacagccgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29327 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgcaccagttatgttggaccgaatgttgcgtctcttggcttgttacaatatcctcacttgttcagttcgtactcaacaagatggaaaggttcagagactttatggtttggctactgttgctaa

SEQ ID NO: 29328 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgcaccagttatgttggaccgaatgttgcgtctcttggcttgttacaatatcctcacttgttcagttcgtactcaacaagatggaaaagttcagagactttatggtttggctactgttgctaa

SEQ ID NO: 29329 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgcaccagttatgttggaccgaatgttgcgtctcttggcttgttacaatatcctcacttgttctgttcgtactcaacaagatggaaaggttcagagactttatggtttggctactgttgctaa

SEQ ID NO: 29330 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgcaccagttatgttggaccgaatgttgcgtctcttggcttgttacaatatcctcacttgttcagttcgtactcaacaagatggaaagattcagagactttatggtttggctactgttgctaa

SEQ ID NO: 29331 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgcaccagttatgttggaccgaatgttgcgtcgcttggcttgttacaatttcctcacttgttcagttcgtactcaacaagatggaaaggttcagagtctttatggtttggcgactggtgctaa

SEQ ID NO: 29332 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatttgtcctactcaggagagcgttcaccgacaaacaacagataaaacgaaaggcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29333 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatttgtcctactcaggagagcgttcaccgacaaacaacagataaaacgaaaggcatgcaccagttatgttggaccgaatgttgcgtctcttggcttgttacaatatcctcacttgttcagttcgtactcaacaagatggaaagattcagagactttatggtttggctactgttgctaa

SEQ ID NO: 29334 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgctccagttatgttggaccgaatgttgcgtctcttggcttgttacaatatcctcacttgttcagttcgtactcaacaagatggaaaagttcagagactttatggtttggctactgttgctaa

SEQ ID NO: 29335 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 29336 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcactagttatgttggaccgaatgttgcgtctcttggcttgttacaatatcctcacttgttcagttcgtactcaacaagatggaaaggttcagagactttatggtttggctactgttgctaa

SEQ ID NO: 29337 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgtttgaccgaatgttgcgtctcttggcttgttacaatatcctcacttgttcagttcgtactcaacaagatggaaaggttcagagactttatggtttggctactgttgctaa

SEQ ID NO: 29338 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgtttgaccgaatgttgcgtctcttggcttgttacaatatcctcacttgttcagtacgtactcaacaagatggaaaggttcagagactttatggtttggctactgttgctaa

SEQ ID NO: 29339 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttgtgccgaatgttgcgtctcttggcttgttacaatatcctcacttgttcagttcgtactcaacaagatggaaaggttcagagactttatggtttggatactgttgctaa

SEQ ID NO: 29340 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttgtaccgaatgttgcgtctctttgcttgttacaatatcctcacttgttcagttcgtactcaacaagatggaaaggttcagagactttatggtttggctactgttgctaa

SEQ ID NO: 29341 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggtccgaatgttgcgtctcttggcttgttacaatatcctcacttgttcagttcgtactcaacaagatggaaaagttcagagactttatggtttggctactgttgctaa

SEQ ID NO: 29342 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29343 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29344 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29345 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcggcgcttggcttgttacaatatcctcacttgttcagttcgtgctcaacaagatggaaaggttcagagactttatggtgtggctactgttgctaa

SEQ ID NO: 29346 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggctggttacaatatcctcacttgttcagttcgtactcaacaagatggaaagattcagagactttatggtttggctactgttgctaa

SEQ ID NO: 29347 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29348 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgcta

SEQ ID NO: 29349 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtcgcttggcttgttacaatatcctcacttgttcagttcgtactcaacaagatggaaaggttcagagactttatggtttggctactgtttcgaa

SEQ ID NO: 29350 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29351 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacgatatcctcacttgttctgttcgtactcaacaagatggaaaggttcagagactttatggtttggctactgttgctaa

SEQ ID NO: 29352 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactttgctaa

SEQ ID NO: 29353 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggacctaatgttgcgtctcttggcttgttacaatatcctcacttgttcagttcgtactcaacaagatggaaaggttcagagactttatggtttggctactgttgctaa

SEQ ID NO: 29354 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgatacaatatcctcacttgttcagttcttactcaacaagatggaaaggttcagagactttatggtttggctactgttgctaa

SEQ ID NO: 29355 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttgtcttgttacaatatcctcccttgttcagttcgtactcaacaagatggaaacgttcagagactttatggtttggctactgttgctaa

SEQ ID NO: 29356 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggtttgttacaatatcctcacttgttcagttcgtactcaacaagatggaaagattcagagactttatggtttggctactgttgctaa

SEQ ID NO: 29357 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctacgttgctaa

SEQ ID NO: 29358 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactctatggtttggctactgttgctaa

SEQ ID NO: 29359 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggatagattcagagactttatggtttggctactgttgctaa

SEQ ID NO: 29360 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgtttcgtctcttgtcttgttacaatatcctcacttgttcatttcgtactcaacaagatggaaagattcagagactttatggtttggctactgttgctaa

SEQ ID NO: 29361 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgctgcgtctcgtggcttgttacaatatcctcacttgttcagttcgtactcaacaagatggaaaggttcagagactttatggtttggctactgttgctaa

SEQ ID NO: 29362 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 29363 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaggatggaaaagttcagagactttatggtttggctactgttgctaa

SEQ ID NO: 29364 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgataa

SEQ ID NO: 29365 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtattcaacaagatggaaaagttcagagactttatggtttggctactgttgctaa

SEQ ID NO: 29366 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgtcgcgtctcttggcttgttacaatatcctcacttgttcagttcgtactcaacaagatggaaagattcagagactttatggtttggctatgttgctaa

SEQ ID NO: 29367 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttataatatcctcacttgttcagttcgtactcaacaagatggaaaagttcagagactttatggtttggctactgttgctaa

SEQ ID NO: 29368 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggtttagagactttatggtttggctactgttgctaa

SEQ ID NO: 29369 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttgacttgttacaatatcctcacttgttcagttcgtactcaacaagatggaaaagttcagagactttatggtttggctactgttgctaa

SEQ ID NO: 29370 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgcctcttggcttgttacaatatcctcacttgttctgttcgtactcaacaagatggaaaggttcagagactttatggtttggctactgttgctaa

SEQ ID NO: 29371 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgtaa

SEQ ID NO: 29372 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactaaacaagatggaaaggttcagagactttatggtttcgctactgttgctaa

SEQ ID NO: 29373 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 29374 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 29375 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatgaaaaggttcagagactttatggtttggctactgttgctaa

SEQ ID NO: 29376 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggattggctactgttgctaa

SEQ ID NO: 29377 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagcctttatggtttggatactgttgctaa

SEQ ID NO: 29378 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 29379 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgcta

SEQ ID NO: 29380 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtatggctactgttgctaa

SEQ ID NO: 29381 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttactatatcctcacttgttcagttcgtactcaacaagatggaaaggttcagagactttatggtttggctactgttgctaa

SEQ ID NO: 29382 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcatactcaacaagatggaaaagttcagagactttatggtttggctactgttgctaa

SEQ ID NO: 29383 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 29384 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttagggtttggctactgttgctaa

SEQ ID NO: 29385 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 29386 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 29387 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgcactcaacaagatggaaagattcagagactttatggtttggctactgttgctaa

SEQ ID NO: 29388 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatgggaaggttcagagactttatggtttggctactgttgctaa

SEQ ID NO: 29389 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgcactcaacaagatggaaaggttcagagactttatggtttggctactgttgctaa

SEQ ID NO: 29390 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaac

SEQ ID NO: 29391 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttattcagttcgtactcaacaagatggaaaggttcagagactttatggtttggctactgttgctaa

SEQ ID NO: 29392 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgctaa

SEQ ID NO: 29393 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtcacttggcttgttacaatatcctcacttgttcagttcgtactcaacaagatggaaaggttcagagactttatggtttggctactgttgctaa

SEQ ID NO: 29394 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagacttgatggtttggctactgttgctaa

SEQ ID NO: 29395 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcctctcttggcttgttacaatatcctcccttgttcagttcgtactcaacaagatggaaaggttcagagactttatggtttggctactgttgctaa

SEQ ID NO: 29396 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttgtcttgttacaatatcctcacttgttcagttcgtactcaacaagatggaaaggttcagagactttatggtttggctactgttgctaa

SEQ ID NO: 29397 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggttactgttgctaa

SEQ ID NO: 29398 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatgggaaagttcagagactttatggtttggctactgttgctaa

SEQ ID NO: 29399 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctctcggcttgttacaatatcctcacttgttcagttcgtactcaacaagatggaaaggttcagagactttatggtttggctactgttgctaa

SEQ ID NO: 29400 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 29401 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactctacaagatggaaaggttcagagactttatggtttggctactgttgctaa

SEQ ID NO: 29402 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatgtcctcactttttcagttcgtactcaacaagatggaaaggttcagagactttatggtttggctactgttgctaa

SEQ ID NO: 29403 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgttctcaacaagatggaaaggttcagagactttatggtttggctactgttgctaa

SEQ ID NO: 29404 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggagaggttcagagactttatggtttggctactgttgctaa

SEQ ID NO: 29405 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctatgttgctaa

SEQ ID NO: 29406 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacatgatggaaaggttcagagactttatggtttggctactgttgctaa

SEQ ID NO: 29407 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaaggttgcgtctcttggcttgttacaatatcctcacttgttcagttcgtactcaacaagatggaaagattcagagactttatggtttggctactgttgctaa

SEQ ID NO: 29408 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcactttttcagttcgtactcaacaagatggaaagattcagagcctttatggtttggctactgttgctaa

SEQ ID NO: 29409 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaac

SEQ ID NO: 29410 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttattgtttggctactgttgctaa

SEQ ID NO: 29411 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagctcgtactcaacaagatggaaaagttcagagactttatggtttggctactgttgctaa

SEQ ID NO: 29412 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 29413 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctag

SEQ ID NO: 29414 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgctgctaa

SEQ ID NO: 29415 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 29416 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgtgctaa

SEQ ID NO: 29417 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggcactgttgctaa

SEQ ID NO: 29418 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttgacttgttacaatatcctcacttgttcagttcgtactcaacaagatggaaagattcagagactttatggtttggctactgttgctaa

SEQ ID NO: 29419 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttgactgttgctaa

SEQ ID NO: 29420 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggctggttacaatatcctcacttgttcagttcgtactcaacaagatggaaaggttcagagactttatggtttggctactgttgctaa

SEQ ID NO: 29421 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcttactcaacaagatggaaaggttcagagactttatggtttggctactgttgctaa

SEQ ID NO: 29422 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagcctttatgatttggctactgttgctaa

SEQ ID NO: 29423 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatgtaaaggttcagagactttatggtttggctactgttgctaa

SEQ ID NO: 29424 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctacttgttgctaa

SEQ ID NO: 29425 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggttgggctactgttgctaa

SEQ ID NO: 29426 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagttggaaaggttcagagactttatggtttggctactgttgctaa

SEQ ID NO: 29427 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatgcaaaggttcagagactttatggtttggctactgttgctaa

SEQ ID NO: 29428 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttctgagcctttatggtttggctactgttgctaa

SEQ ID NO: 29429 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagggactttatggtttggctactgttgctaa

SEQ ID NO: 29430 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttgacttgttacaatatcctcacttgttctgttcgtactcaacaagatggaaaggttcagagactttatggtttggctactgttgctaa

SEQ ID NO: 29431 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgattgttgcgtctcttggcttgttacaatatcctcacttgttcagtccgtactcaacaagatggaaaggttcagagactttatggtttggctactgttgctaa

SEQ ID NO: 29432 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatccacacttgttcagttcgtactcaacaagatggaaaggttcagagactttatggtttggctactgttgctaa

SEQ ID NO: 29433 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 29434 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggttggctactgttgctaa

SEQ ID NO: 29435 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 29436 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 29437 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtatcttggcttgttacaatatcctcacttgttcagttcgtactcaacaagatggaaagattcagagactttatggtttggctactgttgctaa

SEQ ID NO: 29438 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 29439 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 29440 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgataa

SEQ ID NO: 29441 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttagctactgttgctaa

SEQ ID NO: 29442 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatttcctcacttgttcagttcgtactcaacaagatggaaagattcagagactttatggtttggctactgttgctaa

SEQ ID NO: 29443 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaacgaatgttgcgtctcttggcttgttacaatatcctcacttgttcagttcgtactcaacaagacggaaaggttcagagacattctggtttggctactgttactaa

SEQ ID NO: 29444 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttggtacaatatcctcacttgttcagttcgtactcaacaagatggaaaagttcagagactttatggttgggctactgttgcgaa

SEQ ID NO: 29445 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagtccagagactttatggtttggctactgttgctaa

SEQ ID NO: 29446 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgtatgttgcgtctcttggcttgttacaatatcctcacttgttcagttcgtactcaacaagatggaaaggttcagagactttatggtttggctactgttgctaa

SEQ ID NO: 29447 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatgggttggctactgttgctaac

SEQ ID NO: 29448 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttacgttggaccgaatgttgcgtctcttggcttgttacaatatcctcacttgttcagttcgtactcaacaagatggaaaagttcagagactttatggtttggctactgttgctaa

SEQ ID NO: 29449 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 29450 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 29451 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 29452 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 29453 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagatatgttggaccgaatgttgcgtctcttggcttgttacaatatcctcacttgttcagttcgtactcaacaagatggaaaggttcagagactttatggtttggctactgttgctaa

SEQ ID NO: 29454 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgacggatggcctttttgcgtttctacaaactcttcctggctagcggtaccctgatgcaccagttatgttggaacgaatgttgcgtctcttggcttgttacaatatcctcacttgttcagttcgtactcaacaagatggaaaggttcagagactttatggtttggctactgttgctaa

SEQ ID NO: 29455 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgacggatggcctttttgcgtttctacaaactcttcctggctagcggtaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 29456 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgacgcaccagttatgttggaccgaatgttgcgtctcttggcttgttacaatatcctcacttgttcagttcgtactcaacaagatggaaaggttcagagactttatggtttggctactgttgctaa

SEQ ID NO: 29457 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgaagcaccagttatgttggaccgaatgttgcgtctcttggcttgttacaatatcctcacttgttcagttcgtactcaacaagatggaaaggttcagagactttatggtttggctactgttgctaa

SEQ ID NO: 29458 - DNA, 402 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgaagaagatcgcttggcctcgcgcgcagatcagttggaagaatttgtccactacgtgaaaggcgagatcaccaatctcttggcttgttacaatatcctcacttgttcagttcgtactcaacaagatggaaaggttcagagactttatggtttggctactgttgctaa

SEQ ID NO: 29459 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcacctgttatgttggaccgaatgttgcgtcacttggcttgttacaatatcctcacttgttcagttcgtactcaacaagatggaaaggttcagagactttatggtttggctactgttgctaa

SEQ ID NO: 29460 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29461 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29462 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29463 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29464 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctacttgttgctaa

SEQ ID NO: 29465 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 29466 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcatactcaacaagatggaaaagttcagagactttatggtttggctactgttgctaa

SEQ ID NO: 29467 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacgatatcctcacttgttcagttcgtactcaacaagatggaaaggttcagagactttatggtttggctactgttgataa

SEQ ID NO: 29468 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaagttcagagactttatggtttggctactgtttctaa

SEQ ID NO: 29469 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgcgaa

SEQ ID NO: 29470 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 29471 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatagtttggctactgttgctaa

SEQ ID NO: 29472 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaagttcagagactttatggtttggctactggtgctaa

SEQ ID NO: 29473 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttaggttggaccgaatgttgcgtctcttggcttgttacaatatcctcacttgttcagttcgtactcaacaagatggaaaggttcagggactttatggtttggctactgttgctaa

SEQ ID NO: 29474 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 29475 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 29476 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctccaggggaagccgaagtttccaaaaggtcgttgatcaaagctcgccgcgttgtttcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29477 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcgtaaccgtatcgatatgctctcaaccggcattaaaagcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29478 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcgtaaccgtatcgatatgctctcaaccggcattaaaagcccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29479 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcctgctgcaccagttatgttggaccgaatgttgcgtctcttggcttgttacaatatcctcacttgttcagttcgtactcaacaagatggaaaagttcagagactttagggtttggctactgaggctaa

SEQ ID NO: 29480 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29481 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29482 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29483 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaggatggaaaagttcagagactttatggtttggctactgttgctaa

SEQ ID NO: 29484 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 29485 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaagattcagagactttatggtttggctactgttgctat

SEQ ID NO: 29486 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcctgatgcaccagttatgttggaccgaatgatgcgtctcttggcttgttacaatatcctcacttgttcagttcgtactcaacaagatggaaagattcagagactttatggtttggctactgttgctaa

SEQ ID NO: 29487 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29488 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcctgatgcaccagttatgttggaccgaatgtggcgtctcttggcttgttacaatatcctcacttgttcagttcgtactcaacaagatggaaaggttcagagcctttatggtttggctactgttgctaa

SEQ ID NO: 29489 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 29490 - DNA, 466 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactccgtctccagcgccggcttgccgccatcggggctggcgatggccaccccctgctccggggtcaagccgtgggcctggcacagcaccggcaacagccgctggaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29491 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactccctgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 29492 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29493 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactccctgatgcaccagttatgttggaccgaatgttgcgtctcttggcttgttacaatatcctcacttgttcagttcgtactcaacaagatggaaagattcagagactttatggtttggctactgttgataa

SEQ ID NO: 29494 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29495 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactccctgatgcaccagttacgttggaccgaatgttgcgtctcttggcttgttacaatatcctcacttgttcagttcgtactcaacaagatggaaaagttcagagactttatggtttggctactgttgctaa

SEQ ID NO: 29496 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcattgccaaatgtttgaacgatcgcgccctcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29497 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcattgccaaatgtttgaacgatcgcgccctcctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 29498 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29499 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaagattcagagactttatggtttggctactgttgctaa

SEQ ID NO: 29500 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcatgcaccagttatgttggaccgaatgttgcgtcgcttggcttgttacaatatcctcacttgttcagttcgtactcaacaagatggaaaggttcagagactttatggtttggctactgttgctaa

SEQ ID NO: 29501 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29502 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaaggttcagagactttatggtttggctactgtgctaa

SEQ ID NO: 29503 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcatgcaccagttatgttggaccgaatgttgcgtctattggcttgttacaatatcctcacttgttcagttcgtactcaacaagatggaaaggttcagagactttatggtttggctactgttgctaa

SEQ ID NO: 29504 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcaccagttatgttggaccgaatgttgcgtctcttggcttgttacaatatcctcacttgttcagttcgtactcaacaagatggaaaggttcagagactttatggtttgtctactgttgctaa

SEQ ID NO: 29505 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29506 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaagattcagagactttatggtttggctactgttgctaa

SEQ ID NO: 29507 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29508 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatccgcacttgttcagttcgtactcaacaagatggaaaggttcagagactttatggtttggctactgttgctaa

SEQ ID NO: 29509 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctattgttgctaa

SEQ ID NO: 29510 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29511 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttgtcttgttacaatatcctcacttgttcagttcgcactcaacaagatggaaaggttcagagactttatggtttggctactgttgctaa

SEQ ID NO: 29512 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29513 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagggactttatggtttggctactgttgctaa

SEQ ID NO: 29514 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaagattcagagactttatggtttggctactgtgctaa

SEQ ID NO: 29515 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttagctactgttgctaa

SEQ ID NO: 29516 - DNA, 428 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatcaacttgaccccggagcaggtggtggccatcgccagccacgatggcggcaagcaggcgctggacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29517 - DNA, 428 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatcaacttgaccccggagcaggtggtggccatcgccagccacgatggcggcaagcaggcgctggacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29518 - DNA, 428 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatcaacttgaccccggagcaggtggtggccatcgccagccacgatggcggcaagcaggcgctggacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29519 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaggcggatttgtcctactcaggagagcgttcaccgacaaacaacagataaaacgaaaggctcagtatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29520 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaggcggatttgtcctactcaggagagcgttcaccgacaaacaacagataaaacgaaaggctcagtatgcaccagttatgttggaccgaatgttgcgtctcttggcttgttacaatatcctcacttgttcagttcgtactcaacaagatggaaagattcagagactttatggtttggctactgttgctaa

SEQ ID NO: 29521 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaggcggatttgtcctactcaggagagcgttcaccgacaaacaacagataaaacgaaaggctcagtatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29522 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaggcggatttgtcctactcaggagagcgttcaccgacaaacaacagataaaacgaaaggcccagtctgcaccagttatgttggaccgaatgttgcgtctcttggcttgttacaatatcctcacttgttcagttcgtactcaacaagatggaaaggttcagagactttatggtttggctactgttgctaa

SEQ ID NO: 29523 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaggcggatttgtcctactcaggagagcgttcaccgacaaacaacagataaaacgaaaggcccagtctgcaccagttatgttggaccgaatgttgcgtctcttggcttgttacaatatcctcacttgttcagttcgtactcaacaagatggaaagattcagagactttatggtttggctactgttgctaa

SEQ ID NO: 29524 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaggcggatttgtcctactcaggagagcgttttccgacgaacaacagataaaacgaaaggctcagtatgcaccagttatgttggaccgaatggtgcgtctcttgacttgttacaatatcctcacttgttcagttcgtactcaacaagatggaaacggtctgagactatatggtttggcgactgttgctaa

SEQ ID NO: 29525 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaggcgctggagacggtgcaggcgctgttgccggtgctgtgccaggcccacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 29526 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaggcgctggagacggtgcaggcgctgttgccggtgctgtgccaggcccacctgatgcaccagtcatgttggaccgaatgttgcgtctcttggcttgttacaatatcctcacttgttcagttcgtactcaacaagatggaaagattcagagactttatggttcggctactgttgctaa

SEQ ID NO: 29527 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaggcaacagcgcctgcaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29528 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaggcaacagcgcctgcaccgtctccagcgccctgatgcaccagttatgttggaccgaatgttgcgtctcttggcttgttacaatatcctcacttgttcagttcgtactcaacaagatggaaagattcagagactttatggtttggctactgttgcta

SEQ ID NO: 29529 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaggcaacagcgcctgcaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29530 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaggcaacagcgcctgcaccgtctccagcgccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 29531 - DNA, 441 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaggacaggtatccggtaagcggcagggtcggaacaggagagcgcacgagggagcttccagggggaaacgcctggtatctttaatgcaccagttatgttggaccgaatgttgcgtctcttggcttgttacaatatcctcacttgttcagttcgtactcaacaagatggaaagattcagagactttatggtttggctactgttgctaa

SEQ ID NO: 29532 - DNA, 441 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaggacaggtatccggtaagcggcagggtcggaacaggagagcgcacgagggagcttccagggggaaacgcctggtatctttaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29533 - DNA, 419 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagctggaccgtctccagcgcctgcttgccgccatcgtggctggcggtggccaccaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29534 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagcgtgaccgagttcaagttcctgttcgtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29535 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagcgtgaccgagttcaagttcctgttcgtgatgcaccagttattttggaccgaatgttgcgtctcttggcttgttacaatatcctcacttgttcagttcgtactcaacaagatggaaaggttcagagactttatggtttggctactgttgctaa

SEQ ID NO: 29536 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagcgtgaccgagttcaagttcctgttcgtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29537 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagccgtgggcctggcacagccccggcaccagccgcgggaccgtctccagcgcctgcttgccaccgccattgctggcgatggctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29538 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagccgccatcgtggctggcgatggcccccacctgctccggggtcaagccgtgggcctggcacagcaccggcaacagccgctggaccgtctccagcgcctctgatgcaccagttatgttggaccgaatgttgcgtctcttggcttgttgcaatatcctcgcttgttcagttcgtactcaacaagatggaaagattcagagactttatggtttggctactgttgctaa

SEQ ID NO: 29539 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagccgccatcgtggcgggagatggcccccccctgctgcggggtcaagccgtgggcctggcacagcaccggcaacagccgctggaccgtctccagcgcctctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29540 - DNA, 465 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagcccacggcttgaccccccagccggtggtggccatcgccagccacgatggcggcaagcaggcgctgggagaggcggtttgcgtattgggcgctcttccgcttctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29541 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagccaggcccacggcttgaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29542 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagccaggcccacggcttgaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29543 - DNA, 383 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagccaggcccacggcttgaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29544 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagccaccctccgggccgttgcttcacaacgttcaaatccgctcccggcggatttgtcctactcaggagagcgttcaccgacaaacaacagataaaacgaaaggcccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29545 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagccaccctccgggccggtgcttgacgacgttcaaatcggctcccggcggatttgtcctactcaggagagcgttcaccgacaaacaacagagaaagcgaaaggcgcactgatgcaccagttatgttggaccgaatgttgcgtctcttggcttgttacaatatcctcacttgttcagttcgtactcaacaagatggaaagattcagagactttatggtttggctactgttgctag

SEQ ID NO: 29546 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagcaccagttatgttggaccgaatgttgcgtctcttggcttgttacaatatcctcacttgttcagttcgtactcaacaagatggaaaggttcagagactttatggtttggctactgttgctaa

SEQ ID NO: 29547 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagactgggcctttcgttttatctgttgtttgtcggtgaacgctctcctgagtaggacaaatccgccgggagcggatttgaacgttgtgaagcaacggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29548 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29549 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29550 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29551 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29552 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacggctacactagaagaacagtatttggtatctgcgctctgctgaagccagttaccttcggaaaaagagttggtagctcttgatccggcaaacaaaccaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29553 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacggctacactagaagaacagtattcggtatctgcgctctgctgaagccagttaccttcggaaaaagagttggtagctcttgatccggcaaacaaaccaccgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29554 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacggctacactagaagaacagtatttggtatctgcgctctgctgaagccagttgccttcggaaaaagagttggtagctcttgatccggcaaacaaaccgccgatgcaccagttatgtgggaccgaatgttgcatctcttggcttgttacaatatcctcacttgttcagttcgtactcaacaagatggaaagattctgagactttatggtttggctactgttgctaa

SEQ ID NO: 29555 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29556 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacctgatgcaccagttatgttggaccggatgttgcgtctcttgggttgttacaatatcctcacttgttcagttcgtactcaaggagatggagagattcagagggtttatggtttgggtactgttggtag

SEQ ID NO: 29557 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29558 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 29559 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaggttcagagactttatggtttggctactttgctaa

SEQ ID NO: 29560 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccggcaacagccgctggaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29561 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccggcaacagccgctggaccgtctccagcactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29562 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttaccatatcctcacttgttcagttcgtactcaacaagatggaaaggttcagagactttatggtttggctactggtgctaa

SEQ ID NO: 29563 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29564 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29565 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29566 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29567 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 29568 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttaaaatatcctcacttgttcagttcgtactcaacaagatggaaaggttcagagactttatggtttggctactgttgctaa

SEQ ID NO: 29569 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttggtacaatatcctcacttgttctgttcgtactcaacaagatggaaaggttcagagactttatggtttggctactgttgctaa

SEQ ID NO: 29570 - DNA, 430 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacccacggcttgaccccggagcaggtggtggccatcgccagccacgatggcggcaagcaggcgctggactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29571 - DNA, 430 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacccacggcttgaccccggagcaggtggtggccatcgccagccacgatggcggcaagcaggcgctggactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29572 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaattttattttgactgatagtgacctgttcgttgcaacaaattgataagcaatgctttcttataatgccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29573 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaattttattttgactgatagtgacctgttcgttgcaacaaattgataagcaatgctttcttataatgccaacgatgcaccagttatgttggaccgaatgttgcgtctcttggcttgttacaatatcctcacttgttcagttcgtactcaacaagatggaaaggttcagagactctatggtttggctactgttgctaa

SEQ ID NO: 29574 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29575 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29576 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 29577 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29578 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 29579 - DNA, 446 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaatatattatgctagtaaataccaacatataacataacaaaataccactcaacaaaatatactaactaaattataaaaagacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29580 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaggcgctggagacggtccagcggctgttgccctgatgcaccagttatgttggaccgaatgtttcgtctcttggcttgttacaatatcctcacttgttcagttcgtactcaacgagatggaaaggttcagagactttatggtttggctactgttgctaa

SEQ ID NO: 29581 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaggcgctggagacggtccagcggctgttgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29582 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaggcgctggagacggtccagcggctgttgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29583 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaagccgtgggcctggcccagccccggcaacagccgctggaccgtctccagcgcctgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29584 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaagccgtgggcctggcacagcaccggcaccagccgctggaccgtctccagcgcctgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29585 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaagccgtgggcctggcacagcaccggcaacagccgctggaccgtctccagcgcctgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29586 - DNA, 388 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaagccagttaccttcggaaaaagagtctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29587 - DNA, 388 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaagccagttaccttcggaaaaagagtctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29588 - DNA, 388 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaagccagttaccttcggaaaaagagtctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29589 - DNA, 388 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaagccagttaccttcggaaaaaaagtctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29590 - DNA, 388 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaagccagttaccttcggaaaaaaagtctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29591 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaagcaccagttatgttggaccgaatgttgcgtctcttggcttgttacaatatcctcacttgttcagttcgtactcaacaagatggaaaggttcagagactttatggtttggctactgttgctaa

SEQ ID NO: 29592 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaagcaccagttatgttggaccgaatgttgcgtctcttggcttgttacaatatcctcacttgttcagttcgtactcaacaagatggaaagattcagagactttatggtttggctactgttgctaa

SEQ ID NO: 29593 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaactccagcgcctgcttgccgccatcgtggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29594 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaactccagcgcctgcttgccgccatcgtggccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29595 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaactccagcgcctgcttgccgccatcgtggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29596 - DNA, 415 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacgccattatttccgccgaactgaaccccgcgtctattattgatggtgtgcgctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 29597 - DNA, 415 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacgccattatctccgacgcactgaaccacgcgtctattattgatggtgtgcgctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29598 - DNA, 415 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacgccattatctccgacgcactgaaccacgcgtctattattgatggtgtgcgctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 29599 - DNA, 415 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacgccattatctccgacgcactgaaccacgcgtctattattgatggtgtgcgctgatgcaccagttatgttggaccgaatgttgcgtctcttggctggttacaatatcctcacttgttcagttcgtactcaacaagatggaaagattcagagactttatggtttggctactgttgctaa

SEQ ID NO: 29600 - DNA, 415 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacgccattatctccgacgcactgaaccacgcgtctattattgatggtgtgcgctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29601 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacgcaccagttatgttggaccgaatgttgcgtctcttggcttgttacaatatcctcacttgttcagttcgtactcaacaagatggaaagattcagagactttatggtttggctactgttgctaa

SEQ ID NO: 29602 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 29603 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29604 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29605 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29606 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttctgagactttatggtttggctctgttgctaa

SEQ ID NO: 29607 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 29608 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29609 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29610 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaaggtggaaaggttcagagactttatggtttggctactgttgctaa

SEQ ID NO: 29611 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttagggtttggctatgttgctaa

SEQ ID NO: 29612 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaagattcagagactttatggtttggctactgttgcta

SEQ ID NO: 29613 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 29614 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 29615 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 29616 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 29617 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagtcatgttggaccgaatgttgcgtctcttggcttgttacaatatcctcacttgttctgttcgtcctcaacaagatggaaaggttcagagcctttatggtttggctactgttgctaa

SEQ ID NO: 29618 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctatgttggaccgaatgttgcgtctcttggcttgttacaatatcctcacttgttcagttcgtactcaacaagatggaaaggttcagagactttatggtttggctactgttgctaa

SEQ ID NO: 29619 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctatgttggaccgaatgttgcgtctcttggcttgttacaatatcctcacttgttcagttcgtactcaacaagatggaaaagttcagagactttatggtttggctactgttgctaa

SEQ ID NO: 29620 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccggcaacagcgcctgcaccgtctccagcgcctgcttgccaccaatattgctggcgatggccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29621 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccggcaacagcgcctgcaccgtctccagcgcctgcttgtcaccaatattgctggcgatggccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29622 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccggcaacagcgcctgcaccgtctccagcgcctgcttgccaccaatattgctggcgatggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29623 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccggcaacagcgcctgcaccgtctccagcgcctgcttgccaccaatattgctggcgatggccctgatgcaccagttatgttggaccgaatgttgcgtctcttggcttgttacaatatcctcacttgttcagttcgtactcaacaagatggaaaagtgcagagactttatggtttggctagttgctaa

SEQ ID NO: 29624 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccggcaacagcgcctgcaccgtctccagcgcctgcttgccaccaatattgctggcgatggccctgatgtaccagttatgttggaccgaatgttgcgtctcttggcttgttacaatatcctcacttgttcagttcgtactcaacaagatggaaaagttcagagactttatggtttggctactgttgctaa

SEQ ID NO: 29625 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccggcaacagcgcctgcaccgtctccagcgcctgcttgccaccaatattgctggcgatggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29626 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccggcaacagcgcctgcaccgtctccagcgcctgcttgccaccaatattgctggcgatggccctgatgtaccagttatgttggaccgaatgttgcgtctcttggcttgttacaatatcctcacttgttcagttcgtactcaacaagatggaaaggttcagagactttatggtttggctactgttgctaa

SEQ ID NO: 29627 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccgccatcgtggctggcgatggcccccacctgctccggggtcaagccgtgggcctggcacagcaccggcaacagccgctggaccgtctccagcgcctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29628 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccgccatcgtggctggcgatggccaccccctgctccggggtcaagccgtgggcctggcacagcaccggcagcagccgctggaccgtctccagcgcctctgatgcaccagttatgttggaccgaatgttgcgtctcttggctggttacaatatcctcacttgttcagttcgtactcaacaagatggaaaggttcagagactttatggtttggctactgttgctaa

SEQ ID NO: 29629 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccgccatcgtggctggcgatggccaccacctgctccggggtcaagccgtgggcctggcacagcaccggcaacagccgctggaccgtctccagcgcctctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29630 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccgcaaaaaggccatccgtcaggatggccttctgcttagctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29631 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccgcaaaaaggccatccgtcaggatggccttctgcttagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29632 - DNA, 428 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccgaacaggcttatgtccactgggttcgtgtggtggccatcgccagccacgatggcggcaagcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29633 - DNA, 427 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccgaacaggcttatgtccgctgggttcgtgtggtggccatcgccggcacgatggcggcaagcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29634 - DNA, 428 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccgaacaggcttatgtccacggggttcgtgtggtggccatcgccagccacgatggcggcaagctctgatgcaccagttatgttggacagaatgttgtgtctcttgacgtgttacaatatcctcgcttgttcagttcgtactcatcaagatggaaaggttcgaagactttatggtttggctactgttgctaa

SEQ ID NO: 29635 - DNA, 428 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccgaacaggcttaggtccactgggttcgtgtggtggccatcgccagccacgatggcggcaagcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29636 - DNA, 440 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctggaggaggtgaggaggaagttcaacaacggcgagatcaacttcgcggccgactgataactcgagaagggcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29637 - DNA, 440 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctggaggaggtgaggaggaagttcaacaacggcgagatcaacgtcgcggccgactgataactcgagaagggcgcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29638 - DNA, 440 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctggaggaggtgaggaggaagttcaacaacggcgagatcaacttcgcggccgactgataactcgagaagggcgcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29639 - DNA, 440 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctggaggaggtgaggaggaagtgcaacaacggcgagatcaacttcgcggccgactgataactcgagaagggcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29640 - DNA, 440 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctggaggaggtgaggaggaagttcaacaacggcgagatccacttcgcggccgactgataactcgagaagggcgcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29641 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccctatgcaccagttatgttggaccgaatgttgcgtctcttggcttgttacaatatcctcacttgttcagttcgtactcaacaagatggaaagattcagagactttatggtttggctactgttgctaa

SEQ ID NO: 29642 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccgtgggcctggcacagcaccggcaacagcgccctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 29643 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccgtgggcctggcacagcaccggcaacagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29644 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccgtgggcctggcacagcaccggcaacagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29645 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccgtgggcctggcacagcaccggcaacagcgccctgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 29646 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccgctggaccgtctccagcgcctgcttgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29647 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29648 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29649 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29650 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 29651 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 29652 - DNA, 472 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccccggagcaggtggtggccatcgccagcaagattggtggcaagcaggcgctggagacggtgcaggcgctgttgccggtgctgtgccaggcccacggcttgaccccccagcatgcaccagttatgttggaccgaatgttgcgtctcttggcttgttacaatatcctcacttgttcagttcgtactcaacaagatggaaagattcagagactttatggtttggctactgttgctaa

SEQ ID NO: 29653 - DNA, 474 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccccggagcaggtggtggccatcgccagcaatattggtggcaagcaggcgctggagacggtgcaggcgctgttgccggtgctgtgccaggcccacggcttgaccgtctccagcatgcaccagttatgttggaccgaatgttgcgtctcttggcttgttacaatatcctcacttgttcagttcgtactcaacaagatggaaagattcagagactttatggtttggctactgttgctaa

SEQ ID NO: 29654 - DNA, 474 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccccggagcaggtggtggccatcgccagcaatattggtggcaagcaggcgctggagacggtgcaggcgctgttgccggtgctgtgccaggcccacggcttgaccgtctccagcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29655 - DNA, 368 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29656 - DNA, 368 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29657 - DNA, 368 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29658 - DNA, 368 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccccctgatgcaccagttatgttggaccgaatgttgcgtctcttggcttgttacaatatcctcacttgttcagttcgtactcaacaagatggaaaggttcagagactttatggtttggctaccgttgctaa

SEQ ID NO: 29659 - DNA, 369 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29660 - DNA, 369 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29661 - DNA, 388 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacccccagcgcctgcttgccaccgccacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29662 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccatatttttttattttttttatttttcaaacctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 29663 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagttcgtactcaacaagatggaaaggttcagagactttatggtttggctactgttgctaa

SEQ ID NO: 29664 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagttcgtactcaacaagatggaaaagttcagagactttatggtttggctactgttgctaa

SEQ ID NO: 29665 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagttcgtactcaacaagatggaaagattcagagactttatggtttggctactgttgctaa

SEQ ID NO: 29666 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagttcgtactcaacaagatggaagggttcagagactttatggtttggctactgttgctaa

SEQ ID NO: 29667 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagttcgtactcaacaagatggaaagattcagagactttatggtttggctagttgctaa

SEQ ID NO: 29668 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagttcgtactcaacaagatggaaaagttcagagactttatggtttggctatgttgctaa

SEQ ID NO: 29669 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccagatgcaccagttatgttggaccgaatgttgcgtctcttggcttgttacaatatcctcacttgttcagttcgtactcaacaagatggaaagattcagagactttatggtttggctactgttgctaa

SEQ ID NO: 29670 - DNA, 440 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccagaccaggaacaagcacatcaaccccaacgagtggtggaaggtgtacccctccagcgtgaccgagttcaagttcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29671 - DNA, 440 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccagaccaggaacaagcacatcaaccccaacgagtggtggaaggtgtacccctccagcgtgaccgagttcaagttcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29672 - DNA, 399 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaccggcaacagcgcctgcaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29673 - DNA, 399 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaccggcaacagcgcctgcaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29674 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaccctccgggccgttgcttcacaacgttcaaatccgctcccggcggatttgtcctactcaggagagcgttcaccgacaaacaacagataaaacgaaaggctcactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29675 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaccctccgggccgttgcttcacaacgttcaaatccgctcccggcggatttgtcctactcaggagagcgttcaccgacaaacaacagataaaacgaaaggctcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29676 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaccctccgggccggtgcttcacaacgttcaaatccgctaccggcggatttgtcctactcaggagagcgttcaccgacaaacaacagataaaacgaaaggctcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29677 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaccagttatgttggaccgaatgttgcgtctcttggcttgttacaatatcctcacttgttcagttcgtactcaacaagatggaaaagttcagagactttatggtttggctactgttgctaa

SEQ ID NO: 29678 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaccagttatgttggaccgaatgttgcgtctcttggcttgttacaatatcctcacttgttcagttcgtactcaacaagatggaaagattcagagactttatggtttggctactgttgctaa

SEQ ID NO: 29679 - DNA, 475 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaccacctgctccggggtcaagccgtgggcctggcacagcaccggcaacagccgctggaccgtctccagcgcctgcttgccgccatcgtggctggcgatggccaccacctgctatgcaccagttatgttggaccgaatgttgcgtctcttggcttgttacaatatcctcacttgttcagttcgtactcaacaagatggaaagattcagagactttatggtttggctactgttgctaa

SEQ ID NO: 29680 - DNA, 473 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaatgctatgaccatgattacgaattcccgatctagtaacatagatgacaccgcgcgcgataatttatcctagtttgcgcgctatattttgttttctatcgcgtaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29681 - DNA, 473 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaatgctatgaccatgattacgaattcccgatctagtaacatagatgacaccgcgcgcgataatttatcctagtttgcgcgctatattttgttttctatcgcgtaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29682 - DNA, 473 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaatgctatgaccatgattacgaattcccgatctagtaacatagatgacaccgcgcgcgataatttatcctagtttgcgcgctatattttgttttctatcgcgtaaccccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29683 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29684 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29685 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaaccctgatgcaccagttatgttggaccgaatgttgcgtctcttggcttgttacaatatcctcacttgttcagttcgtactcaacaagatggaaaagttcagagactttatggtttggctactgttgctta

SEQ ID NO: 29686 - DNA, 466 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacaggattagcagagcgaggtatgtaggcggtgctacagagttcttgaagtggtggcctaactacggctacactagaagaacagtatttggtatctgcgctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29687 - DNA, 466 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacaggattagcagagcgaggtatgtaggcggtgctacagagttcttgaagtggtggcctaactacggctacactagaagaacagtatttggtatctgcgctccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29688 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacagataaaacgaaaggcccagtcttctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29689 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacaccattattgctggcgatggccaccacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29690 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacaccattattgctggcgatggccaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29691 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacaccattattgctggcgatggccaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29692 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacaccattattgctggcgatggccaccaaccctgatgcaccagttatgttggaccgaatgttgcgtctcttggcttgttacaatatcctcacttgttcagttcgtactcaacaagatggaaagattcagagactttatggtttggccactgttgctaa

SEQ ID NO: 29693 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacaccattattgctggcgatggccaccacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29694 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacaccagttatgttggaccgaatgttgcgtctcttggcttgttacaatatcctcacttgttcagttcgtactcaacaagatggaaaggttcagagactttatggtttggctactgttgctaa

SEQ ID NO: 29695 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacaccagttatgttggaccgaatgttgcgtctcttggcttgttacaatatcctcacttgttcagttcgtactcaacaagatggaaagattcagagactttatggtttggctactgttgctaa

SEQ ID NO: 29696 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaatgcaccagttatgtttgaccgaatgttgcgtctcttggcttgttacaatatcctcacttgttcagttcgtactcaacaagatggaaaggttcagagactttatggtttggctactgttgctaa

SEQ ID NO: 29697 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29698 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 29699 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29700 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaatgcaccagttatgttggacagaatgttgcgtctcttggcttgttacaatatactcacttgttcagttcgtacgcaacaagatggaaaggttcagagactttatggtttggctactgttgctaa

SEQ ID NO: 29701 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaacgcaaaaaggccatccgtcaggatggccttctgcttagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29702 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaacgcaaaaaggccatccgtcaggatggccttctgcttagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29703 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29704 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29705 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29706 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29707 - DNA, 366 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaaccctgatgcaccagttatgttggaccgaatgtttcgtctcttggcttgttacaatatcctcacttgttcagttcgtactcaacaagatggaaaggttcagagactttatggtttggctactgttgcta

SEQ ID NO: 29708 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatgtaaaggttcagagactttatggtttggctactgttgctaa

SEQ ID NO: 29709 - DNA, 465 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaacagaattgtaagtttgtaaatgtttgaattctagagagagtagagactagagaggttagagaaatcattcttttgtattgactattgattaaatgttcttctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29710 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgttggaccgaatgttgcgtctcttggcttgttacaatatcctcacttgttcagttcgtactcaacaagatggaaaggttcagagactttatggtttggctactgttgctaa

SEQ ID NO: 29711 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgttatgttggaccgaatgttgcgtctcttggcttgttacaatatcctcacttgttcagttcgtactcaacaagatggaaagattcagagactttatggtttggctactgttgctaa

SEQ ID NO: 29712 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgtactcaacaagatggaaaggttcagagactttatggtttggctactgttgctaa

SEQ ID NO: 29713 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacggatggcctttttgtgtttctacaaactcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29714 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacggatggcctttttgcgtttctacaaactcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29715 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacggatgcaccagttatgttggaccgaatgttgcgtctcttggcttgttacaatatcctcacttgttcagttcgtactcaacaagatggaaagattcagagactttatggtttggctactgttgctaa

SEQ ID NO: 29716 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacggatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29717 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 29718 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgcaccagttatgttggaccgaatgttgcgtctcttggcttgttacaatatcctcacttgttcagttcgtactcaacaagatggaaagattcagagactttatggtttggctactgttgctaa

SEQ ID NO: 29719 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgcaccagttatgttggaccgaatgttgcgtctcttggcttgttacaatatcctcacttgttcagttcgtactcaacaagatggaaaagttcagagactttatggtttggctactgttgctaa

SEQ ID NO: 29720 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29721 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29722 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29723 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29724 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29725 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 29726 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29727 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgtggcaccagttatgtgggccgaatgttgcgtctcttggcttgttacaatatcctcacttgttcagttcgtactcaacaagatggaaaggttcagagactttatggtttggctactgttgctaa

SEQ ID NO: 29728 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgtaccagtcatgttggaccgaatgttgcgtctcttggcttgttacaatatcctcacttgttctgttcgtactcaacaagatggaaaggttcagagactttatggtttggctactgttgctaa

SEQ ID NO: 29729 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatggaccagttatgttggaccgaatgttgcgtctcttggcttgttacaatatcctcacttgttcagttcgtactcaacaagatggaaaggttcagagactttatggtttggctactgttgctaa

SEQ ID NO: 29730 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 29731 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttattttggaccgaatgttgcgtctcttgggttgttacaatatcctcccttgttcagttcgtactcaacaagatggaaaggttcagagcctttatggtttggctactgttgctaa

SEQ ID NO: 29732 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttgtaccgaatgttgcgtctcttggcttgttacaatatcctcacttgttcagttcgtactcaacaagatggaaaagttcagagactttatggtttggctactgttgctaa

SEQ ID NO: 29733 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29734 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29735 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29736 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29737 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 29738 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctgttgctaa

SEQ ID NO: 29739 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctaccgttgctaa

SEQ ID NO: 29740 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttgggccgaatgttgcgtctcttggcttgttacaatatcctcacttgttcagttcgtactcaacaagatggaaaggttcagagactttatggtttggctactgttgctaa

SEQ ID NO: 29741 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgcctcttggcttgttacaatatcctcacttgttcagttcgtactcaacaagatggaaaggttcagagactttatggtttggctactgttgctaa

SEQ ID NO: 29742 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 29743 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttaagagactttatggtttggcta

SEQ ID NO: 29744 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttaaatatcctcacttgttcagttcgtactcaacaagatggaaaggttcagagactttatggtttggctactgttgctaa

SEQ ID NO: 29745 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggttggctactgttgctaa

SEQ ID NO: 29746 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacagtatcctcacttgttcagttcgtactcaacaagatggaaaggttcagagactttatggtttggctactgttgctaa

SEQ ID NO: 29747 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcatgttacaatatcctcacttgttcagttcgtactcaacaagatggaaaggttcagagactttatggtttggctactgttgctaa

SEQ ID NO: 29748 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactctacaagatggaaaggttcagagactttatggtttggctactgttgctaa

SEQ ID NO: 29749 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatgtaaaggttcagagactttatggtttggctactgttgctaa

SEQ ID NO: 29750 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 29751 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgataa

SEQ ID NO: 29752 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggataggttcagagactttatggtttggctactgttgctaa

SEQ ID NO: 29753 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagacggaaaggttcagagactttatggtttggctactgttgctaa

SEQ ID NO: 29754 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgtttctaa

SEQ ID NO: 29755 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgatacaatatcctcacttgttcagttcgtactcaacaagatggaaagattcagagactttatggtttggctaatgttgctaa

SEQ ID NO: 29756 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggtgcagagactttatggtttggctactgttgaa

SEQ ID NO: 29757 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggactgaatgttgcgtctcttggcttgttacaatatcctcacttgttcagttcgtactcaacaagatggaaaggttcagagactttatggtttggctactgttgctaa

SEQ ID NO: 29758 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgtgtctcttggcttgttacaatatcctcacttgttcagttcgtactcaacaagatggaaaggttcagagactttatggtttggctactgttgctaa

SEQ ID NO: 29759 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29760 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctattggcttgttacaatatcctcacttgttcagttcgtactcaacaagatggaaaagttcagagactttatggtttggctactgttgctaa

SEQ ID NO: 29761 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgtgcagttcgtactcaacaagatggaaagattcagagactttaaggtttggctactggtgctaa

SEQ ID NO: 29762 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgtctaa

SEQ ID NO: 29763 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctctcggcttgttacaatatcctcacttgttcagttcgtactcaacaagatggaaagattcagagactttatggtttggctactgttgctaa

SEQ ID NO: 29764 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 29765 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggttcggctactgttgctaa

SEQ ID NO: 29766 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacgatatcctcacttgttcagttcgtactcaacaagatggaaaagttcagagactttatggtttggctactgttgctaa

SEQ ID NO: 29767 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttggtacaatatcctcacttgttcagttcgtactcaacaagatggaaaggttcagagactttatggtttggctactgttgctaa

SEQ ID NO: 29768 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggttggctactgttgctaa

SEQ ID NO: 29769 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgtttgctaa

SEQ ID NO: 29770 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgc

SEQ ID NO: 29771 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagtttcagagactttatggtttggctactgttgctaa

SEQ ID NO: 29772 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgtggcgtctcttggctagttacaatatcctcactttttcagttcgtactcaacaagagggaaaagttcagagacatgatggtttggcaactgttaataa

SEQ ID NO: 29773 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctat

SEQ ID NO: 29774 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 29775 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaataacctcacttgttcagttcgtactcaacaagatggaaaggttcagagactttatggtttggctactgttgctaa

SEQ ID NO: 29776 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttaaaatatcctcacttgttcagttcgtactcaacaagatggaaaggttcagagactttatggtttggctactgttgctaa

SEQ ID NO: 29777 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 29778 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttattgtttggctactgttgctaa

SEQ ID NO: 29779 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttgagagactttatggtttggctactgttgctaa

SEQ ID NO: 29780 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctgttggcttgttacaatatcctcacttgttcagttcgtactcaacaagatggaaaggttcagagactttatggtttggctactgttgctaa

SEQ ID NO: 29781 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttgcctactgttgctaa

SEQ ID NO: 29782 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttttggtttggctactgttgctaa

SEQ ID NO: 29783 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggtttgttacaatatcctcacttgttcagttcgtactcaacaagatggaaaagttcagagcctttatggtttggctactgttgctaa

SEQ ID NO: 29784 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctacttgttgctaa

SEQ ID NO: 29785 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagacgttatggtttggctactgttgctaa

SEQ ID NO: 29786 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttggtaa

SEQ ID NO: 29787 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 29788 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgtcgcgtctcttggcttgttacaatatcctcacttgttcagttcgtactcaacaagatggaaaagttcagagactttatggtttggctactgttgctaa

SEQ ID NO: 29789 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 29790 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttagcttgttacaatatcctcacttgttcagttcgtactcaacaagatggaaaggttcagagactttatggtttggctactgttgctaa

SEQ ID NO: 29791 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgggacaagagccgcacgggggcagggcgtactcaacaagatggaaaagttcagagactttatggtttggctactgttgctaa

SEQ ID NO: 29792 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttataatatcctcacttgttcagttcgtactcaacaagatggaaaagttcagagactttatggtttggctactgttgctaa

SEQ ID NO: 29793 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 29794 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 29795 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgcctcttggcttgttacaatatcctcacttgttcagttcgtactcaacaagatggaaagattcagagactttatggtttggctactgtttctaa

SEQ ID NO: 29796 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggctggttacaatatcctcactggttcagttcgtcctcaacaagatggaaaggttcagagcctttatggtttggctactgttgcgaa

SEQ ID NO: 29797 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaacatggaaaagttcagagactttatggtttggctactgttgctaa

SEQ ID NO: 29798 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgtcacaatatcctcacttgttcagttcgtactcaacaagatggaaagattcagagactttatggtttggctactgttgctaa

SEQ ID NO: 29799 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggcttggctactgttgctaa

SEQ ID NO: 29800 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggcttgttgctaa

SEQ ID NO: 29801 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcctggcttgttacaatatcctcacttgttcagttcgtactcaacaagatggaaaggttcagagactttatggtttggctactgttgctaa

SEQ ID NO: 29802 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggttactgttgctaa

SEQ ID NO: 29803 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttgggttgttacaatatcctcacttgttcagttcgtactcaacaagatggaaaggttcagagactttatggtttggctactgttgctaa

SEQ ID NO: 29804 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttctaa

SEQ ID NO: 29805 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgatgctaa

SEQ ID NO: 29806 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaacgaatgttgcgtctcttggcttgttacaatatcctcacttgttcagttcgtactcaacaagatggaaaggttcagagactttatggtttggctactgttgctaa

SEQ ID NO: 29807 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagaccttatggtttggctactgttgctaa

SEQ ID NO: 29808 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcgacaagatggaaaggttcagagactttatggtttggctactgttgctaa

SEQ ID NO: 29809 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggctcagagactttatggtttggctactgttgctaa

SEQ ID NO: 29810 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgtccagttcgtactcaacaagatggaaaggttcagagactttatggtttggctactgttgctaa

SEQ ID NO: 29811 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgtgggaccgaatgttgcgtctcttggcttgttacaatatcctcacttgttcagttcgtactcaacaagatggaaaggttcagagactttatggtttggatactgttgctaa

SEQ ID NO: 29812 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatggtggaacgaatttttcgtctcttggcttggtacaatatcctcccttgttcagttcgttctcaacaagatggaaaggttcagaggctttatggtttggctactgttgctaa

SEQ ID NO: 29813 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 29814 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 29815 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttctgttcgtactcaacaagatggaaagattcagagactttatggtttggctactgttgctaa

SEQ ID NO: 29816 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccaattatgttggaccgaatgttgcgtctcttggcttgttacaatatcctcacttgttcagttcgtactcaacaagatggaaaggttcagagactttatggtttggctactgttgctaa

SEQ ID NO: 29817 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatctaccagttatgttggaccgaatgttgcgtctcttggcttgttacaatatcctcacttgttcagttcgtactcaacaagatggaaaagttcagagactttatggtttggctactgttgctaa

SEQ ID NO: 29818 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctcatgcaccatttatgttggaccgaatgttgcgtctcttggcttgttacaatatcctcacttgttcagttcgtactcaacaagatggaaaggttcagagactttatggtttggctactgttgctaa

SEQ ID NO: 29819 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29820 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29821 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctaatgcaccagttatgttggaccgaatgttgcgtctcttggcttgttacaatatcctcacttgttcagttcgtacttaacaagatggaaagattcagagactttatggtttggctactgttgctaa

SEQ ID NO: 29822 - DNA, 449 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccgtctccagcggctgttgccgccgccattgctggcgagggccaccacctgctccggggtcaagccgtgggcctggcacagcaccggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29823 - DNA, 449 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccgtctccagcggctgttgccgccgccattgctggcgatggccaccacctgctccggggtcaagccgtgggcctggcacagcaccggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29824 - DNA, 449 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccgtctccagcggctgttgccgccgcaattgctggcgatggccaccgcctgctccggggtcaagccgtgggcctggcacagcaccggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29825 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcgccagttatgttggaccgaatgttgcgtctcttggcttgttacaatatcctcacttgttcagttcgtactcaacaagatggaaaggttcagagactttatggtttggctactgttgctaa

SEQ ID NO: 29826 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgtttgaccgaatgttgcgtctcttggcttgttacaatatcctcacttgttcagttcgtactcaacaagatggaaaggttcagagactgtatggtttggctactgttgctaa

SEQ ID NO: 29827 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29828 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29829 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 29830 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29831 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatccgcacttgttcagttcgtactcaacaagatggaaaagttcagagactttatggtttgggtatgttgctaa

SEQ ID NO: 29832 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29833 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29834 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgcctcttggcttgttacaatatcctcacttgttcagttcgtactcaacaagatggaaagattcagagactttatggtttggctactgttgctaa

SEQ ID NO: 29835 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggttgggctactgttgctaa

SEQ ID NO: 29836 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggatcgaatgttgcgtctcttggcttgttacaatatcctcacttgttcagttcgtactcaacaagatggaaaggttcagagactttatggtttggcactgttgctaa

SEQ ID NO: 29837 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcttctcttggcttgttacaatatcctcacttgttcagttcgtactcaacaagatggaaagattcagagactttatggtttggctactgttgctaa

SEQ ID NO: 29838 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttgggttgttacaatatcctcacttgttcagttcgtactcaacaagatggaaaggttcagagactttatggtttggctactgttgctaa

SEQ ID NO: 29839 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatccgcacttgttcagttcgtactcaacaagatggaaaggttcagagactttatggtttggctactgttgctaa

SEQ ID NO: 29840 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggttactgttgctaa

SEQ ID NO: 29841 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 29842 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaaccagatggaaaggttcagagactttatggtttggatactgttgctaa

SEQ ID NO: 29843 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggataggttcagagactttatggtttggctactgttgctaa

SEQ ID NO: 29844 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 29845 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggattggctactgttgctaa

SEQ ID NO: 29846 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgtatgttgcgtctcttggcttgttacaatatcctcacttgttcagttcgtactcaacaagatggaaaggttcagagactttaggggttggctactgtggctaa

SEQ ID NO: 29847 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttgtcttgttacaatatcctcacttgttctgttcgtactcaacaagatggaaaggttcagagactttatggtttggctactgttgctaa

SEQ ID NO: 29848 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggcaactgttgctaa

SEQ ID NO: 29849 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 29850 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactattgctaa

SEQ ID NO: 29851 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 29852 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcatctcttggcttgttacaatatcctcacttgttcagttcgtactcaacaagatggaaaagttcagagactttatggtttggctactgttgctaa

SEQ ID NO: 29853 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgttaa

SEQ ID NO: 29854 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcactttttcagttcgtactcaacaagatggaaaggttcagagactttatggtttggctactgttgctaa

SEQ ID NO: 29855 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgcaa

SEQ ID NO: 29856 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 29857 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctattggcttgttacaatatcctcacttgttcagttcgtactcaacaagatggaaaggttcagagcctttatggtttggctactgttgctaa

SEQ ID NO: 29858 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgtgcagttcgtactcaacaagatggaaagattcagagactttatggtttggctactgttgctaa

SEQ ID NO: 29859 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 29860 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 29861 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactaaacaagatggaaaagttcagagactttatggtttggctactgttgctaa

SEQ ID NO: 29862 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgatggttgcgtctctgggctggtaacaataccctcacttgtccagtccgtcttaaacaagatgaaaaagttcagagccttatggtttggctactgttgctaa

SEQ ID NO: 29863 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttggtaccataacctcccttgttcagttcgtactcaacaagatggaaaggttcagagactttatggtttggctactgttgctaa

SEQ ID NO: 29864 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtacccaacaagatggaaagattcagagactttatggtttggctactgttgctaa

SEQ ID NO: 29865 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgtttctaa

SEQ ID NO: 29866 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 29867 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctaccgttgctaa

SEQ ID NO: 29868 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttagaccgaatgttgcgtctcttggcttgttacaatatcctcacttgttcagttcgtactcaacaagatggaaaggttcagagactttatggtttggctactgttgctaa

SEQ ID NO: 29869 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 29870 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 29871 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagtcatgttggaccgaatgttgcgtctcttggcttgttacaatatcctcacttgttctgttcgtactcaacaagatggaaaggttcagagactttatggtttggctaca

SEQ ID NO: 29872 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 29873 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 29874 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacccgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 29875 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29876 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacccctgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 29877 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacccctgatgcaccagttatgttggaccgaatgttgcgtctcttggctggttacaatatcctcacttgttctgttcgtactcaacaagatggaaaggttcagagactttatggtttggctactgttgctaa

SEQ ID NO: 29878 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29879 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29880 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29881 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29882 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29883 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29884 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccagttatgttggaccgaatgttgcgtctcttggcttgttacaatatcctcacttgttcagttcgtactcaacaagatggaaaggttcagagactttatggtttggctactgttgctaa

SEQ ID NO: 29885 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccagttatgttggaccgaatgttgcgtctcttggcttgttacaatatcctcacttgttcagttcgtactcaacaagatggaaaagttcagagactttatggtttggctactgttgctaa

SEQ ID NO: 29886 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccagttatgttggaccgaatgttgcgtctcttggcttgttacaatatcctcacttgttcagttcgtactcaacaagatggaaagattcagagactttatggtttggctactgttgctaa

SEQ ID NO: 29887 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccagttatattggaccgaatgttgcgtctcttggcttgttacaatatcctcacttgttcagttcgtactcaacaagatggaaaagttcagagactttatggtttggctactgttgctaa

SEQ ID NO: 29888 - DNA, 432 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccacctgctccggggtcaagccgtgggcctggcacagcaccggcaacagccgctggaccgtctccagcgcctctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29889 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccaccagttatgttggaccgaatgttgcgtctcttggcttgttacaatatcctcacttgttcagttcgtactcaacaagatggaaaggttcagagactttatggtttggctactgttgctaa

SEQ ID NO: 29890 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccaccagttatgttggaccgaatgttgcgtctcttggcttgttacaatatcctcacttgttcagttcgtactcaacaagatggaaagattcagagactttatggtttggctactgttgctaa

SEQ ID NO: 29891 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccaccagttatgttggaccgaatgttgcgtctcttggcttgttacaatatcctcacttgttcagttcgtactcaacaagatggaaaagttcagagactttatggtttggctactgttgctaa

SEQ ID NO: 29892 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccaccagttatgttggaccgaatgttgcgtctcttggcttgttacaatatcctcacttgttctgttcgtactcaacaagatggaaaggttcagagactttatggtttggctactgttgctaa

SEQ ID NO: 29893 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccaccagttatgttggaccgaatgttgcgtctcttggcttgttacaatatcctcacttgttcagttcgtactcaacaagatggaaaggttcagagactttatggattggctactgttgctaa

SEQ ID NO: 29894 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccaacgagtggtggaaggtgtccccctccagcgtgaccgagttcaagttcctgttcgtgtccggccacttcaagggcaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29895 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccaacgagtggtggaaggtgtacccctccagcgtgaccgagttcaagttcctgttcgtgtccggccacttcaagggcaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29896 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgttggaccgaatgttgcgtctcttggcttgttacaatatcctcacttgttcagttcgtactcaacaagatggaaaggttcagagactttatggtttggctactgttgctaa

SEQ ID NO: 29897 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgttggaccgaatgttgcgtctcttggcttgttacaatatcctcacttgttcagttcgtactcaacaagatggaaaagttcagagactttatggtttggctactgttgctaa

SEQ ID NO: 29898 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgttggaccgaatgttgcgtctcttggcttgttacaatatcctcacttgttctgttcgtactcaacaagatggaaaggttcagagactttatggtttggctactgttgctaa

SEQ ID NO: 29899 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29900 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29901 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggagaggttcagagactttatggtttggctactgttgctaa

SEQ ID NO: 29902 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 29903 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttctgttcgtactcaacaagatggaaaggttcagagactttatggtttggctactgtagctaa

SEQ ID NO: 29904 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29905 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactggtgctaa

SEQ ID NO: 29906 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctacctgttgctaa

SEQ ID NO: 29907 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggacctaatgttgcgtctcttggcttgttacaatatcctcacttgttcagttcgtactcaacaagatggaaaggttcagagactttatggtttggctaatgttgctaa

SEQ ID NO: 29908 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggctggttacaatatcctcacttgttcagttcgtactcaacaagatggaaaggttcagagactttatggtttggctactgttgctaa

SEQ ID NO: 29909 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggattgttacaatgtcctcacttgttcagttcgtactcaacaagatggaaaggttcagagactttatggtttggctactgttgctaa

SEQ ID NO: 29910 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgta

SEQ ID NO: 29911 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29912 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacatacaccagttatgttggaccgaatgttgcgtctcttggcttgttacaatatcctcacttgttcagttcgtactcaacaagatggaaaggttcagagactttatggtttggctactgttgctaa

SEQ ID NO: 29913 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacagttatgttggaccgaatgttgcgtctcttggcttgttacaatatcctcacttgttcagttcgtactcaacaagatggaaaagttcagagactttatggtttggctactgttgctaa

SEQ ID NO: 29914 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacagttatgttggaccgaatgttgcgtctcttggcttgttacaatatcctcacttgttcagttcgtactcaacaagatggaaaggttcagagactttatggtttggctactgttgctaa

SEQ ID NO: 29915 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacagttatgttggaccgaatgttgcgtctcttggcttgttacaatatcctcacttgttctgttcgtactcaacaagatggaaaggttcagagactttatggtttggctactgttgctaa

SEQ ID NO: 29916 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacacgcaattaatacgcgtaccgctagccaggaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29917 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29918 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29919 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacacctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 29920 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacacctgatgcaccagttatgttggaccgaatgttgcgtctcttggcttgttacaatatcctcacttgttcagttcgtactcaacaagatggaaaggttcagagactttatggttttggctactgttgctaa

SEQ ID NO: 29921 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29922 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacaccggcaacagccgctggaccgtctccagcgcctgcttgccaccattattgctggcgatggccaccacctgctggggggtcaagccgtgggcctggcacagcactactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29923 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacaccggcaacagccgctggaccgtctccagcgcctgcttgccaccattattgctggcgatgaccaccacctgctggggggtcaagccgtgggcctggcacagcactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29924 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacaccggcaacagccgctggaccgtctccagcgcctgcttgccaccattattgctggcgatggccaccacctgctggggggtcaagccgtgggcctggcacagcactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29925 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacaccggcaacagccgctggaccgtctccagcgcctgcttgccaccattattgctggcgatggccaccgcctgctggggggtcaagccgtgggcctggcacagcactactgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 29926 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaaggttcagagactttatggtttggctactgttgctaa

SEQ ID NO: 29927 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaagattcagagactttatggtttggctactgttgctaa

SEQ ID NO: 29928 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaaagttcagagactttatggtttggctactgttgctaa

SEQ ID NO: 29929 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttctgttcgtactcaacaagatggaaaggttcagagactttatggtttggctactgttgctaa

SEQ ID NO: 29930 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatactcacttgttcagttcgtactcaacaagatggaaaggttcagagactttatggtttggctactgttgctaa

SEQ ID NO: 29931 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaattgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29932 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttgggccgaattttgcctcccttggcttgttacaatttcctcccttgttcagttccttctcaaccagatggaaaggttcagagaccttatggtttggctactgttgctaa

SEQ ID NO: 29933 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggatcgaatgttgcgtctcttggcttgttacaatatcctcacttgttcagttcgtactcaacaagatggaaagattcagagactttatggtttggctactgttgctaa

SEQ ID NO: 29934 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29935 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29936 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 29937 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggtccagagactttatggtttggctactgttgctaa

SEQ ID NO: 29938 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggctggttacaatatcctcacttgttcagttcgtactcaacaagatggaaaagttcagagactttatggtttggctactgttgctaa

SEQ ID NO: 29939 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29940 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcgacaagatggaaagattcagagactttatggtttggctactgttgctaa

SEQ ID NO: 29941 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctctttgcttgttaccatatcctcacttgttcagttcgtactcaacaagattgaaaagttcagagactttatggtttggctactgttgctaa

SEQ ID NO: 29942 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaagttcagagactttatggtttggctaccgttgctaa

SEQ ID NO: 29943 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcatactcaacaagatggaaaagttcagagactttatggtttggctactgttgctaa

SEQ ID NO: 29944 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtcctcaacaagatggaaaggttcagagactttatggtttggctactgttgctaa

SEQ ID NO: 29945 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 29946 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29947 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29948 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29949 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgatgcaccagttatgttggaccgaatgttgcgtctcttggcttgttacaatatcctcacttgtgcagttcgtactcaacaagatggaaagtttcagagactttatggtttggcgactgttgctaa

SEQ ID NO: 29950 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgatgcaccagttatgttggacctaatgttgcgtctcttggcttgttacaatatcctcacttgttcagttcgtactcaacaagatggaaaggttcagagactttatggtttggctactgttgctaa

SEQ ID NO: 29951 - DNA, 446 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaataatatattatactagtaaataccaacatataacataacaaaataccactcaacaaaatatactaactaaattataaaaagacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29952 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaagttatctcgccctgatccggcgttggcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29953 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaagttatctcgccctgatccggcgttggcccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29954 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaagttatctcgccctgatccggcgttggcccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29955 - DNA, 466 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaagggtttacacacgcgcacatcgttgcgttaagccaacacccggcagcgttagggaccgtcgctgtcaagtatcaggacatgatcgcagcgttgccagaggcgacacctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 29956 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaagggtttacacacgcgcacatcgttgcgttaagccaacacccggcagcgttagggaccgtcgctgtcaagtatcaggacatgatcgcagcgttgccagaggcgacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29957 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaagggtttacacacgcgcacatcgttgcgttaagccaacacccggcagcgttagggaccgtcgctgtcaagtatcaggacatgatcgcagcgttgccagaggcgacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29958 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaagggtttacacacgcgcacatcgttgcgttaagccaacacccggcagcgttagggaccgtcgctgtcaagtatcaggacatgagcgcagcgttgccagaggcgacacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 29959 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29960 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29961 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 29962 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggctcgttacaatatcctcacttgttcagttcgtactcaacaagatggaaaggttcagagactttatggtttggctactgttgctaa

SEQ ID NO: 29963 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29964 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 29965 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaggttcagagactttatggtttggtactgttgctaa

SEQ ID NO: 29966 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatattggaccgaatgttgcgtctcttggcttgttacaatatcctcacttgttcagttcgtactcaacaagatggaaaggttcagagactttatggtttggctactgttgctaa

SEQ ID NO: 29967 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29968 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29969 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29970 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaacctgatgcaccagttatgttggaccgaatgttgcgtctcttggcttgttacaatatcctcacttgttcagttcgtactcaacaagatggaaaagttcagagactttatggtttggctactggtgctaa

SEQ ID NO: 29971 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaacctgatgcaccagttatgttggatcgaatgttgcgtctcttggcttgttacaatatcctcacttgttcagttcgtactcaacaagatggaaaagttcagagactttatggtttggctactgttgctaa

SEQ ID NO: 29972 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaaccagttatgttggaccgaatgttgcgtctcttggcttgttacaatatcctcacttgttcagttcgtactcaacaagatggaaaggttcggagactttatggtttggctactgttgctaa

SEQ ID NO: 29973 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaaccagttatgttggaccgaatgttgcgtctcttggcttgttacaatatcctcacttgttcagttcgtactcaacaagatggaaaggttcagagactttatggtttggctactgttgctaa

SEQ ID NO: 29974 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaaccagttatgttggaccgaatgttgcgtctcttggcttgttacaatatcctcacttgttcagttcgtactcaacaagatggaaagattcagagactttatggtttggctactgttgctaa

SEQ ID NO: 29975 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaaccagttatgttggaccgaatgttgcgtctcttggcttgttgcaatgtcctcacttgttcggttcgtactcagcgagatggaaaggttcggaggctttatggtttggctactgttgctaa

SEQ ID NO: 29976 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaaccagttatgttggaccgaatgttgcgtctcttggcttgttacaatatcctcacttgttcagttcgtactcaacaagatggaaaggttcagagcctttatggtttggctactgttgctaa

SEQ ID NO: 29977 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaaccagttatgttggaccgaatgttgcgtctcttggcttgttacaatatcctcacttgttctgttcgtactcaacaagatggaaaggttcagagactttatggtttggctactgttgctaa

SEQ ID NO: 29978 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaaagcgacttttgaacgcgcaataatggtttctgacgtatgtgcttagctcattaaactccagaaacccgcggctgagtggctccttcaacgttgcggttctgtcaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29979 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29980 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29981 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttcagttcgtactcaacaagatggaaagattcagagactttatggtttggctactgttgctaa

SEQ ID NO: 29982 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttcagttcgtactcaacaagatggaaaggttcagagactttatggtttggctactgttgctaa

SEQ ID NO: 29983 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttcagttcgtactcaacaagatggaaaagttcagagactttatggtttggctactgttgctaa

SEQ ID NO: 29984 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttctgttcgtactcaacaagatggaaaggttcagagactttatggtttggtactgttgctaa

SEQ ID NO: 29985 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttctgttcgtactcgacaagatggaaaggttcagagactttatggtttggctactgttgctaa

SEQ ID NO: 29986 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 29987 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29988 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacaacctgatgcaccagttatgttggaccgaatgttgcgtctcttggcttgttacaatatcctcacttgttcagttcgtactcaacaagatggaaaggttcagagactttatggtttggctactgttctaa

SEQ ID NO: 29989 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacaaacaacctgatgcaccagtcatgttggaccgaatgttgcgtctcttggcttgttacaatatcctcacttgttctgttcgtactcaacaagatggaaaggttcagagactttatgggttggctactgttgctaa

SEQ ID NO: 29990 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 29991 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaagattcagagactttatggtttggctactgttgctaa

SEQ ID NO: 29992 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 29993 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaagttcagagactttatggtttggctacgttgctaa

SEQ ID NO: 29994 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaggttcagagactttatggtttggctactgttg

SEQ ID NO: 29995 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttctgttcgtactcaacaagatggaaaggttcagagactttatggtttggctatgttgctaa

SEQ ID NO: 29996 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaatgcaccagttatgttggaccgaatgatgcgtctcttggcttgttacaatatcctcacttgttcagttcgtactcaacaagatggaaaggttcagagactttatggtttggctactgttgctaa

SEQ ID NO: 29997 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaatgcaccagttatgttgaaccgaatgttgcgtcacttggcttgttacaatatcctcacttgttcagttcgtactcaacaagatggaaaggttcagagactttatggtttggctactgtagctaa

SEQ ID NO: 29998 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaatgcaccagtcatgttggaccgaatgttgcgtctcttggcttgttacaatatcctcacttgttcagttcgtactcaacaagatggaaagattcagagactttatggtttgctctgttgctaa

SEQ ID NO: 29999 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30000 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30001 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30002 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30003 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30004 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30005 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30006 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcccccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 30007 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcccccaacaactaacggggtcaagccgtgggcctggcacagcaccggcaacagccgctggaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30008 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagccaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30009 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagccaccaacaactctccaggggaagccgaagtttccaaaaggtcgttgatcaaagctcgccgcgttgtttcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30010 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagccaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30011 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcacccaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 30012 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30013 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagatgcaccagttatgttggaccgaatgttgcgtctcttggcttgttacaatatcctcacttgttcagttcgtactcaacaagatggaaagattcagagactttatggtttggctactgttgctaa

SEQ ID NO: 30014 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30015 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagatgcaccagttatgttggaccgaatgttgcgtctcttggcttgttacaatatcctcacttgttcagttcgtactcaacaagatgggaagattcagagactttatggtttggctactgttgctaa

SEQ ID NO: 30016 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagataccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30017 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagaccgaatgttgcgtctcttggcttgttacaatatcctcacttgttcagttcgtactcaacaagatggaaagattcagagactttatggtttggctactgttgctaa

SEQ ID NO: 30018 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagaccgaatgttgcgtctcttggcttgttacaatatcctcacttgttcagttcgtactcaacaagatggaaaggttcagagactttatggtttggctactgttgctaa

SEQ ID NO: 30019 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagaccgaatgttgcgtctcttggcttgttacaatatcctcacttgttcagttcgtactcaacaagatggaaaagttcagagactttatggtttggctactgttgctaa

SEQ ID NO: 30020 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagaccgaatgttgcgtctcttggcttgttacaatatcctcacttgttctgttcgtactcaacaagatggaaaggttcagagactttatggtttggctactgttgctaa

SEQ ID NO: 30021 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30022 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcacctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 30023 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30024 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaagattcagagactttatggtttggctactgttgctaa

SEQ ID NO: 30025 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaaggttcagagactttatggtttggctactgttgctaa

SEQ ID NO: 30026 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaaggttcagagcctttatggtttggctactgttgctaa

SEQ ID NO: 30027 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaactaccaacaactggcacagcaccggcaacagccgctggaccgtctccagcaccagttatgttggaccgaatgttgcgtctcttggcttgttacaatatcctcacttgttcagttcgtactcaagaagatggaaaggttcagagactttatggtttggctactgttgctaa

SEQ ID NO: 30028 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaactaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30029 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaactaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30030 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaactaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30031 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaactaccaacaacaccagttatgttggaccgaatgttgcgtctcttggcttgttacaatatcctcacttgttcagttcgtactcaacaagatggaaaggttcagagactttatggtttggctactgttgctaa

SEQ ID NO: 30032 - DNA, 270 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaacaagatggaaaggttcagagactttatggtttggctactgttgctaa

SEQ ID NO: 30033 - DNA, 270 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaacaagatggaaaagttcagagactttatggtttggctactgttgctaa

SEQ ID NO: 30034 - DNA, 270 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaacaagatggaaaagttcagagactttatggtttggctgctgttgctaa

SEQ ID NO: 30035 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttcgcagctaccaacaactaggcaacagcgcctgcaccgtcttcagcgccctgatgcaccagttatgttggaccgaatgtggcgtctcttggcttgttacaatatcctcacttgtacagttcgtactcaacaagatggaaaggttcagagactttatggttaggctactgttgctaa

SEQ ID NO: 30036 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttcgcagctaccaacaacatgttggaccgaatgttgcgtctcttggcttgttacaatatcctcacttgttcagttcgtgctcaacaagatggaaaggttcagagactttatggtttggctagtgtggctaa

SEQ ID NO: 30037 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttcctagctaacaacaatacgaaacagttatctgggactgaaagttgcctcacttgacttgttacaatatcctcacttgttcagttcgtactcaacaagatggaaaagttcagagactttatggtttggctactgttgctaa

SEQ ID NO: 30038 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttcccagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30039 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttcccagctaccctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30040 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttcccagctaccaacaatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 30041 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttcccagctaccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30042 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30043 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttcagctaccaacaagatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 30044 - DNA, 431 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttatcagctcccaacaactaaccgccatcgtggctggcgatggccaccacctgctggggggtcaagccgtgggcctggcacagcactactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30045 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttatcagctaccaacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30046 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgctcctcagctaccaacaacttgcaccagttatgttggaccgaatgttgcgtctcttggcttgttacaatatcctcacttgttcagttcgtactcaacaagatggaaaagttcagagactttatggtttggccactgttgctaa

SEQ ID NO: 30047 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgctcctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30048 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgctactcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30049 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcctctcagctaccaacaactaacccctgatgcaccagttatgttggactgaatgttgcgtctcttggcttgttacaatatcctcacttgttcagttcgtactcaacaagatggaaaggttcagagactttatggtttggctactgttgctaa

SEQ ID NO: 30050 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcctctcagctaccaacaactaaacgcaaaaaggccatccgtcaggatggccttctgcttagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30051 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcatctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30052 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcatctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30053 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30054 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30055 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30056 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattccttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30057 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattacttctcagctaccaataaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30058 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattacttctcagctaccaacaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30059 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30060 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatggcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30061 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatgatgcaccagttatgttggaccgaatgttgcgtctcttgggttgttacaatatcctcacttgttcagttcgtactcaacaagatggaaaggttcagagactttatggtttggctactgttgctaa

SEQ ID NO: 30062 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30063 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30064 - DNA, 337 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttcagttcgtactcaacaagatggaaaggttcagagactttatggtttggctactgttgtaa

SEQ ID NO: 30065 - DNA, 337 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 30066 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30067 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30068 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30069 - DNA, 339 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatctgatgcaccagttatgttggaccgaatgttgcgtctcttggcttgttacaatatccacacttgttcagttcgtactcaacaagatggaaagattcagagactttatggtttgctactgttgctaa

SEQ ID NO: 30070 - DNA, 339 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagatggaaagattcagagactttatggtttggctctgttgctaa

SEQ ID NO: 30071 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30072 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30073 - DNA, 339 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagatggaaaggttcagagactttatggtttggctactgttgtaa

SEQ ID NO: 30074 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagatggaaaggttgagagactttatggtttggctactgttgctaa

SEQ ID NO: 30075 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaatctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 30076 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30077 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30078 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30079 - DNA, 331 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaaccagttatgttggaccgaatgttgcgtctcttggcttgttacaatatcctcacttgttcagttcgtactcaacaagatggaaaggttcagagactttatggtttggctactgttgctaa

SEQ ID NO: 30080 - DNA, 331 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaaccagttatgttggaccgaatgttgcgtctcttggcttgttacaatatcctcacttgttcagttcgtactcaacaagatggaaaggttcagagcctttatggtttggctactgttgctaa

SEQ ID NO: 30081 - DNA, 331 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaaccagttatgttggaccgaatgttgcgtctcttggcttgttacaatatcctcacttgttcagttcgtactcaacaagatggaaagattcagagactttatggtttggctactgttgctaa

SEQ ID NO: 30082 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattcaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30083 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattaaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30084 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatggaaattgcttctcagctaccaacaactgtcaggatggccttctgcttagtttgatgccgggcagtttatggcgggcggccggcccgccaccctgatgcaccagttatgttggaccgaatgttgcgtctcttggcttggtacaatatcctcacttgttcagtgcgtactcaacaagagggaaaggttcagagactttatggtttggcgactgttgctaa

SEQ ID NO: 30085 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatcgaaattgcttcttagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30086 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatcgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 30087 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatcgaaattgcttctcagctcccaacaacctgatgcaccagttatgttggaccgaatgttgcgtctcttggcttgttacaatatcctcacttgttcagttcttactcaacaagatggaaaggttcagagactttatggtttggctactgttgctaa

SEQ ID NO: 30088 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatcgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30089 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatcgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30090 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatcgaaattgcttctcagctaccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30091 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatagaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30092 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatagaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30093 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctaatgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30094 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctaatgaaattgcttctcagctaccaaccctgatgcaccagttatgttggaccgaatgttgcgtctcttggcttgttacaatatcctcacttgttcagttcatactcaacaagatggaaaggttcagagactttatggtttggctactgttgctaa

SEQ ID NO: 30095 - DNA, 440 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctaatgaaattgcttctcagctaccaacaactaaccagaccaggaacaagcacatcaaccccaacgagtggtggaaggtgtacccctccagcgtgaccgagttcaagttcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30096 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctaatgaaattgcttctcagctaccaacaacctgatgcaccagttatgttggaccgaatgttgcgtctctttgcttgttacaatatcctcacttgttcagttcgtactcaacaagatggaaaggttcagagactgtatggtttggctactgttgctaa

SEQ ID NO: 30097 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacccattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30098 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacccattgaaattgcttctcagctaccctatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30099 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacccattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30100 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacccattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30101 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacccattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30102 - DNA, 449 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacccattgaaattgcttctcagctaccaacaaccgtctccagcggctgttgccgccgccattgctggcgatggccaccacctgctccggggtcaagccgtgggcctggcacagcaccggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30103 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcaccattgaaatcgcttctcagctatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30104 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcaccagtcatgttggaccgaatgttgcgtctcttggcttgttacaatatcctcacttgttcagttcgtactcaacaagatggaaaggttcagagactttatggtttggctactgttgctaa

SEQ ID NO: 30105 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcaccagtcatgttggaccgaatgttgcgtctcttggcttgttacaatatcctcacttgttctgttcgtactcaacaagatggaaaggttcagagactttatggtttggctactgttgctaa

SEQ ID NO: 30106 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcaccagtcatgttggaccgaatgttgcgtctcttggcttgttacaatatcctcacttgttcagttcgtactcaacaagatggaaagattcagagactttatggtttggctactgttgctaa

SEQ ID NO: 30107 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacatattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30108 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcaactattgaaattgcttctcagctcccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30109 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcaactattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30110 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaattgcacctattgaaattgcttctcagctaccaacaactaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30111 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaattccacctattgaaattgcttctcagctaccaacaactgatgcaccagttatgttggacctaatgttgcgtctcttggcttgttacaatatcctcacttgttcagttcgtactcaacaagatggaaaggttcagagactttatggtttggctactgttgctaa

SEQ ID NO: 30112 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaattccacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30113 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaattacacctattgaaattgcttctcagctcccaacaaccctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 30114 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaattacacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30115 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaattacacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctatgttgctaa

SEQ ID NO: 30116 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaattacacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30117 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatgtcacctattgaaattgcttctcagctaccaacaacttatgttggaccgaatgttgcgtctcttggcttgttacaatatcctcacttgttcagttcgtactcaacaagatggaaaagttcagagactttatggtttggctactgttgctaa

SEQ ID NO: 30118 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatctcgcctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30119 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatctcacctattgaaattgcttctcagctaccaacaactcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30120 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatctcacctattgaaattgcttctcagctaccaacaactaagccgtgggcctggcacagcaccggcaacagccgctggaccgtctccagcgcctgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30121 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatctcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30122 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaagttcacctattgaaattgcttctcagctaccaacatgatgcaccagttatgttggaccgaatgttgcgtctcttggcttgttacaatatccgcacttgttcagttcgtactcaacaagatggaaaggttcagagactgtatggtttggctactgttgctaa

SEQ ID NO: 30123 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaacttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30124 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaacttcacctattgaaattgcttctcagctaccaacaactgatgcaccagttatgttggaccgaatgtcgcgtctcttggcttgttacaatatcctcacttgttcagttcgtactcaacaagatggaaaggttcagagactttatggtttggctactgttctaa

SEQ ID NO: 30125 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaaattcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30126 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30127 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctaaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30128 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcgcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30129 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcgcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30130 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcgcaaatttcacctattgaaattgcgtctcagctaccaacacctgatgcaccagttatgttgtaccgaatgttgcgtctcttggctagttacaatatcctcacttgttcagttcgtactcaacaagatggaaaagttcagagactttatggtttggctactgttgctaa

SEQ ID NO: 30131 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30132 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30133 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctaccaacaactgatgcaccagttatgttggaccgaatgttgcgtctcttggcttgttacaatatcctcacttgttcagttcgtactcaacaagatggaaaggtccagagactttatggtttggctactgttgctaa

SEQ ID NO: 30134 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcccaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30135 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcaccagttatgttggaccgaatgttgcgtctctttgcttgttacaatatcctcacttgttcagttcgtactcaacaagatggaaaggttcagagactttatggtttggctactgttgctaa

SEQ ID NO: 30136 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 30137 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaagattcagagactttatggtttggctactgttgctaa

SEQ ID NO: 30138 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaaagttcagagactttatggtttggctactgttgctaa

SEQ ID NO: 30139 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcaccagttatgttggaccgaatgttgcgtctcctggcttgttacaatatcctcacttgttcagttcgtactcaacaagatggaaaagttcagagactttatggtttggctactgttgctaa

SEQ ID NO: 30140 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcacaaatttcacctattgaaattgcttctcagctcccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30141 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcacaaatttcacctattgaaattgcttctcagctaccaacactgatgcaccagttatgttggaacgaatgttgcgtctcttggcttgttacaatatcctcacttgttcagttcgtactcaacaagatggaaaggttcagagactttatggtttggctactgttgctaa

SEQ ID NO: 30142 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcacaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30143 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcacaaatttcacctattgaaattgcttctcagctaccaacaactcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30144 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30145 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30146 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30147 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgatgcaccagttatgttggaccgaatgttgcgtctcttggcttgttacaatatcctcacttgttcagttcgtactcaacaagatggaaaagttcagagactttatggtttgctactgttgctaa

SEQ ID NO: 30148 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgatcaaatttcacctgttcaaattgcttctcagcttccaacaactaatgcaccagtcatgttgggccgaatgttgcgtctcttggcttgttacaatatcctcacttgttctgttcgtactcaacaagatggaaaggttcagagactttatggtttggctactgttgctaa

SEQ ID NO: 30149 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgatcaaatttcacctattgaaattgcttctcagctcccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30150 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgatcaaatttcacctattgaaattgcttctcagctaccaacatgcaccagttatgttggaccaaatgttgcgtctcttggcttgttacaatatcctcacttgttcagttcgtactcaacaagatggaaagattcagagactttatggtttggctactgttgctaa

SEQ ID NO: 30151 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgatcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30152 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgatcaaatttcacctattgaaattgcttctcagctaccaacaacctaatgcaccagttatgttggaccgaatgttgcgtctcttggcttgttacaatatcctcacttgttcagttcgtgctcaacaagatggaaaggttcagagactttatggtttggctactgttgctaa

SEQ ID NO: 30153 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtcctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30154 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctatttaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30155 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgagattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30156 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30157 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30158 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctcccaacaactaaccacctgctggggggtcaagccgtgggcctggcacagcaccggcaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30159 - DNA, 335 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctcccaacaaaatgttgcgtctcttggcttgttacaatatcctcacttgttcagttcgtactcaacaagatggaaagattcagagcctttatggtttggctactgttgctaa

SEQ ID NO: 30160 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30161 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30162 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30163 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30164 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30165 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30166 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30167 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30168 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30169 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30170 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 30171 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30172 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30173 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaaccctgatgcaccagttatattgtaccgaatgttgcgtctcttgtcttgttacaatatcctcacttgttcaattcgtactcaacaagatgtaaatgttcagacactttatggtttcgctactgttgctaa

SEQ ID NO: 30174 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggcgctcaaatttcacctgttcaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30175 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggcgctcaaatttcacctattgaaattgcttctcagctaccaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30176 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctgctgctcaaatttcacctattgaaattgcttctcagctcccaacaactacctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 30177 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctgctgctcaaatttcacctattgaaattgcttctcagctaccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30178 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30179 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30180 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctagtgctcaaatttcacctattgaaattgcttctcagctcccaacctggtgcaccagttatgttggaccgaatgttgcgtctcttggcttgttacaatatcctcacttgttcagttcgtactcaacaagatggaaaggttcagagactttatggtttggctactggtgctaa

SEQ ID NO: 30181 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctagtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30182 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctagtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30183 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctagtaatcaaatttcacctattgaaattacttctcagctaccaacaacctgatgcaccacttatgttagaccgaatgttacgtctcttggcttgttacaatatcctcacttgttcagttcgtactcaacaagatggaaaggttcagagactttatggtttggctactgttgctaa

SEQ ID NO: 30184 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccgaatgttgcgtctcttggcttgttacaatatcctcacttgttctgttcgtactcaacaagatggaaaggttcagagactttatggtttggctactgttgctaa

SEQ ID NO: 30185 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccgaatgttgcgtctcttggcttgttacaatatcctcacttgttcagttcgtactcaacaagatggaaaggttcagagactttatggtttggctactgttgctaa

SEQ ID NO: 30186 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccgaatgttgcgtctcttggcttgttacaatatcctcacttgttcagttcgtactcaacaagatggaaaggttcagagcctttatggtttggctactgttgctaa

SEQ ID NO: 30187 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccgaatgttgcgtctcttggcttgttacaatatcctcacttgttcagttcgtactcaacaagatggaaagattcagagactttatggtttggctactgttgctaa

SEQ ID NO: 30188 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccgaatgtcgcgtctcttggcttgttacaatatcctcacttgttcagttcgtactcaacaagatggaaaggttcagagactttatggtttggctactgttgctaa

SEQ ID NO: 30189 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacccggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30190 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacccggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30191 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacccggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30192 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccaggtgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30193 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccaggtgctcaaatttcacctattgaaattgcttctcagctcccaacaactgatgcaccagttatgttgaatccaatattgaatcacatggcttgttacaatagcctcacttgttcagttcgtcctcaactagatggaaaggttcagagactttatggtttggctactgttgctaa

SEQ ID NO: 30194 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccaggtgctcaaatttcacctattgaaattgcttctcagctaccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30195 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccaggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30196 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccaggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30197 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccaggtgataaaatttcacctattgaaattgcttctaagctaccaacaactgcatgatgcaccagttaggttggaccgaatgttgcgtctcttggcttgttacaatatcctcacttgttcagttcgtactcaacaagatggaaaggttaagagactttatggtttggataatgttgataa

SEQ ID NO: 30198 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacatggtgctcaaatttcacctattgaaattgcttctcagctaccaacaactaaccagttatgttggaccgaatgttgcgtctcttggcttgttacaatatcctcacttgttcagttcgtactcaacaagatggaaaagttcagagactttatggtttggctactgttgctaa

SEQ ID NO: 30199 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacatggtgctcaaatttcacctattgaaattacttctcaattaccaatgcaccagttatgttgaaccgaatgttgcgtctcttggcttgttacaatatcctcacttgttcagttcgtactcaacaagatggaaagattcagagactttatggtttggctactgttgctaa

SEQ ID NO: 30200 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaactggtgctcaaatttcacgtattgaaattgcttttcagctaccaacatcctgatacaccagttatgttggaccgaatgttgcgtctcttggcttgttacaatatcctcacttgttcagttcgtactcaacaagatggaaaggttcagagactttatggtttggctactgttgctaa

SEQ ID NO: 30201 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaactggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30202 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaactggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30203 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30204 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30205 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgcctgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 30206 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30207 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgcacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30208 - DNA, 410 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgcaccgtctccagcgcctgcttgccaccaatattgctggcgatggccaccacctgctccggggtcaagccgtgggcctggcacagcaccggcaacagccgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30209 - DNA, 410 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgcaccgtctccagcgcctgcttgccaccaatattgctggcgatggccaccacctgctccggggtcaagccgtgggcctggcacagcaccggcaacagccgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30210 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgagttatgttgtaccgaatgttgcgtctcttggcttgttacaatatcctcacttgttcagttcgtactcaacaagatggaaaggttcagagactttatggtttggctactgttgctaa

SEQ ID NO: 30211 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaaggttcagagactttatggtttggctactgttgctaa

SEQ ID NO: 30212 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaaagttcagagactttatggtttggctactgttgctaa

SEQ ID NO: 30213 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaaggttcagagactttatggtttggctactgttgccaa

SEQ ID NO: 30214 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaagattcagagactttatggtttggctactgttgctaa

SEQ ID NO: 30215 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatgtaaaggttcagagactttatggtttggctactgttgctaa

SEQ ID NO: 30216 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgaacctggtgctcaaatttcacctattgaaattgcttctcagctcccaacaactaccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30217 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgaacctggtgctcaaatttcacctattgaaattgcttctcagctaccaacaaccaacgagtggtggaaggtgtacccctccagcgtgaccgagttcaagttcctgttcgtgtccggccacttcaagggcaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30218 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctagacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30219 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctagacctggtgctcaaatttcacctattgaaattgcttctcagctaccaacaactatgcaccagttatgttggaccgaatgttgcgtctcttggcttgttacaatatcctcacttgttcagttcgtactcaacaagatggaaagattcagagactttatggtttggctactgttgctaa

SEQ ID NO: 30220 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctagacctggtgctcaaatttcacctattgaaattgcttctcagctaccaacaactaacctatgttggaccgaatgttgcgtctcttggcttgttacaatatcctcacttgttcagttcgtactcaacaagatggaaaggttcagagactttatggtttggctactgttgctaa

SEQ ID NO: 30221 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctagacctggtgctcaaatttcacctattgaaattgcttctcagctaccaacaaccctggtgcaccagttattttggaccgaatgttgcgtctcttggcttgttacaatatcctcacttgttcagttcgtacccaacaagttggaaaagttcagagacagtatggtttggctactgttgctaa

SEQ ID NO: 30222 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagccggacctggtgctcaaatttcaccttttgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30223 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagccggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30224 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagccggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30225 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagccggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30226 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagccggacctggtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30227 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagcaggacctggtgctcaccagttatgttggaccgaatgttgcgtctcttggcttgttacaatatcctcacttgttcagttcgtactcaacaagatggaaaggttcagagactttatggtttggctactgttgctaa

SEQ ID NO: 30228 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagcaggacctggtgctcaaatttcacctattgaaattgcttctcagctcccaacaactaacaacaacaaaccaacccttagttgcacacccttgtgtttttctttgtttgttgtttgttttattttcttagtccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30229 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagatgtacctggtgttcaaatttcgcctattgaaattgcttctcagctaccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30230 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagatggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30231 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaacctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30232 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaaactggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30233 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccaaagctggacctggtgctcaaatttcacctattgaaatttcaccagttatgttggaccgaatgttgcgtctcttggcttgttacaatatcctcacttgttcagttcgtactcaacaagatggaaaggttcagagactttatggtttggctactgttgctaa

SEQ ID NO: 30234 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccaaagctggacctggtgctcaaatttcacctattgaaattgcttctcagctcccaacaactgatgcaccagttatgttggaccgaatgttgcgtctcttggcttgttacaaaatcctcacttgttcagttcgtactcaacaagatggaaagattcagagactttatggtttggctactgttgcaa

SEQ ID NO: 30235 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30236 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgccaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30237 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgataaagctggacctggtgctcaaatttcacgtattgaaattgcttctcagctaccaatgcaccagttatgttggaccgaatgttgcgtctcttggcttgatacaatatcctcacttgttcagttcgtactcaacaagatggaaaggttcagagactttatggtttggctactgttgctaa

SEQ ID NO: 30238 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgataaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30239 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgataaagctggacctggtgctcaaatttcacctattgaaattgcttctcagctaccaacaacgatgcaccagttatgttggaccgaatgtggcgtctcttggcttgttacaatatcctcacttgttctgttcgtacttaacaagatggaaaggttcagagactttatggtttggctactggtgctaa

SEQ ID NO: 30240 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagctcccaacaactaccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30241 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30242 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30243 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattactaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30244 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattactaaagctggacctggtgctcaaatttcaccagtcatgttggaccgaatgttgcgtctcttggcttgttacaatatcctcacttgttctgttcgtactcaacaagatggaaaggttcagagactttatggtttggctactgttgctaa

SEQ ID NO: 30245 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatggctaaagctggacctggtgctcaaatttcacctattgaaattgcttctcagctcccaacaactaccggcaacagccgctggaccgtctccagcgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30246 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatcgctaaagctggacctggtgctcaaatttcacctgttcaaattgcttctcagcttccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30247 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatcgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30248 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatcgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30249 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatcgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 30250 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcatcgctaaagctggacctggtgcccaaatttcacctattgaaattgcttctcagctaccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30251 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaataattgctaaagctggacctggttctcaaatttcacctattggaattgcttctcagctaccaacaactgatgcaccagttatgttggaccgaatgttgcgtctcttggcttgttacaatatcctcacttgttcagtttgtactcaacaagatggaaaagttcagagactttatggtttggctactgttgctaa

SEQ ID NO: 30252 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaccattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30253 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaaccattgctaaagctggacctggtgctcaaatttcacctattgaaattgcttctcagctaccaacaactccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30254 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30255 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttaaaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30256 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctcagaaatcattgctaaagctggacctggtgctcaaatttcacctattgaaattgcttctcagctcccaacaccagttatgttggaccgaatgttgcgtctcttggcttgttacaatatcctcacttgttcagttcgtactcaacaagatggaaagattcagagactttatggtttggctactgttgctaa

SEQ ID NO: 30257 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctcagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30258 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctcagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30259 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctcagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30260 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctcagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30261 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctcagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaagttcagagactttatggtttggctactgttgctaa

SEQ ID NO: 30262 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctcagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30263 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctcagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30264 - DNA, 316 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctagaaatcattgctaaagctggacctggtgtgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30265 - DNA, 333 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctagaaatcattgctaaagctggacctggtgctcaaatttcacctattgaaattgcttctcagctaccaccaaatgttgcgtctcttagcttgttacaatatcctcacttgttcagttcgtactcaacaagatggaaaggttcagagactttatggtttggctactgttgctaa

SEQ ID NO: 30266 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctctagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30267 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcctagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaggttcagagactttatggtttggctactgttgctaa

SEQ ID NO: 30268 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctacaagatggaaaggttcagagactttatggtttggctactgttgctaa

SEQ ID NO: 30269 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctacaagatggaaagattcagagactttatggtttggctactgttgctaa

SEQ ID NO: 30270 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcacttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30271 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatcacttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30272 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatatcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30273 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgaactcttagaaatcattgctaaagctggacctggtgctcaccagttatgttggaccgaatgttgcgtctcttggcttgttacaatatcctcacttgttcagttcgtactcaacaagatggaaaggttcagagactttatggtttggctactgttgctaa

SEQ ID NO: 30274 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgaactcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30275 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30276 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaatcattgctaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30277 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctattgaaattgcttctcagctcccaacaacctgatgcaccagttatgtttgaccgaatgttgcgtctcttggcttgttacaatatcctcacttgttcagttcgtactcaacaagatggaaaggttcagagactttatggtttggctactgttgctaa

SEQ ID NO: 30278 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 30279 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30280 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30281 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30282 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctattgaaattgcttctcagctaccaacaacctgatgcaccagttatgttggaccgaaggttgcgtctcttggcttgttacaatatcctcacttgttcagttcgtactcaacaagatggaaaagttcagagactttatggtttggctactgttgctaa

SEQ ID NO: 30283 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30284 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30285 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaactcgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30286 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacgtgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30287 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctgatctcttggcttgttacaatatcctcacttgttcagttcgtactcaacaagatggaaaggttcagagactttatggtttggctactgttgctaa

SEQ ID NO: 30288 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 30289 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30290 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacatgatctcttagaaatcattgctaaagctggacctggtgctcaaatttcacctattgaaattgcttctcagctcccaacaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30291 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacatgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30292 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacatgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30293 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttaaacttgatctcttagaaatcattgctaaagctggacctggtgctcaaatttcacctattgaaattgtttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30294 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttaaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30295 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttaaacttgatctcgtagaaatcattgctaaagctggacctggtgctcaaatttcacctattgaaattgcttctcagctaccaacaactttatgttggaccgaatgttgcgtctcttggcttgttacaatatcctcacttgttcagttcgtactcaacaagatggaaaggttcagagactttatggtttggctactgttgctaa

SEQ ID NO: 30296 - DNA, 269 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctgcaccagttatgttggaccgaatgttgcgtctcttggcttgttacaatatcctcacttgttctgttcgtactcaacaagatggaaaggttcagagactttatggtttggctactgttgctaa

SEQ ID NO: 30297 - DNA, 269 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctgcaccagttatgttggaccgaatgttgcgtctcttggcttgttacaatatcctcacttgttcagttcgtactcaacaagatggaaagattcagagactttatggtttggctactgttgctaa

SEQ ID NO: 30298 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30299 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30300 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaagattcagagcctttatggtttggctactgttgctaa

SEQ ID NO: 30301 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30302 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30303 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30304 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30305 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctaccaacaactaaggcgctggagacggtccagcggctgttgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30306 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30307 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30308 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctcttagaaatcattgctaaagctggacctggtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30309 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctcgaacttgatctctcagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30310 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctatgttgtaccgaatgttgcgtctcttggcttgttacaatatcctcacttgttcagttcgtactcaacaagatggaaagattcagagactttatggtttggctactgttgctaa

SEQ ID NO: 30311 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttctgttcgtactcaacaagatggaaaggttcagagactttatggtttggctactgttgctaa

SEQ ID NO: 30312 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttcggttcgtactcaacaagatggaaaggttcagagactttatggtttggctactgttgctaa

SEQ ID NO: 30313 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttcagttcgtactcaacaagatggaaaggttcagggactttatggtttggctactgttgctaa

SEQ ID NO: 30314 - DNA, 259 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactttgctaa

SEQ ID NO: 30315 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactgttgctaa

SEQ ID NO: 30316 - DNA, 256 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactgttg

SEQ ID NO: 30317 - DNA, 258 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttcagttcgtactcaacaagatggaaaggtgcagagactttatggtttggctagttgctaa

SEQ ID NO: 30318 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttcagttcgtactcaacaagatggaaagattcagagactttatggtttggctactgttgctaa

SEQ ID NO: 30319 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttcagttcgtactcaacaagatggaaaagttcagagactttatggtttggctactgttgctaa

SEQ ID NO: 30320 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctagaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30321 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcgtgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30322 - DNA, 404 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcctgaacttgatctcttagaaatcattgctaaagctggacctggtgctcaaatttcacctattgaaattgcttctcagctcccaacaactggggtcaagccgtgggcctggcacagcaccggcaacagccgctggatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30323 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcctgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 30324 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcctgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30325 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcctgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30326 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcatgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30327 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcatgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30328 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcatgaacttgatctcttagaaatcattgctaaagctggacctggtgctcaaatttcacctattgaaattgcttctcagctaccaacaactaaggcgctggagacggtccagcggctgttgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30329 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcatgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30330 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctattgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30331 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctattgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30332 - DNA, 337 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagcccttgaacttgatctcttagaaatcattgctaaagctggacctggtgctcaaatttcacctattgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30333 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagcccttgaacttgatctcttagaaatcattgctaaagctggacctggtgctcaaatttcacctattgaaattgcttctcagctcccaacaactatgttgcgtctcttggcttgttacaatatcctcacttgttcagttcgtactcaacaagatggaaagattcagagactttatggtttggctactgttgctaa

SEQ ID NO: 30334 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagcccttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30335 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagcccttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30336 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagatcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30337 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagatcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30338 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcaactcttgaacttgatctcttagaaatcattgctaaagctggacctggtgctcaaatttcacctattgaaattgcttctcagctcccaacaactggaccgaatgttgcgtctcttggcttgttacaatatcctcacttgttcagttcgtactcaacaagatggaaagattcagagactttatggtttggctactgttgctaa

SEQ ID NO: 30339 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcaactcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30340 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcaactcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30341 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcaactcttgaacttgatctcttagaaatcattgataaagctggacctggtgctcaaatttcacctattgaaattgcttctcagctaccaacaaccatgcaccagttatgttggaccgaatgttgcggctcttggcttgttacaatatcctcacttgttcagttcgtactcaacaagatggaaagattcagagactttatggtttggctactgttgctaa

SEQ ID NO: 30342 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaataagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30343 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaataagctcttgaacttgatctcttagaaatcattgctaaagctggacctggtgctcaaatttcacctattgaaattgcttctcagctcccaacaccagttatgttggaccgaatgttgcgtctcttggcttgttacaatatcctcacttgttcagttcgtactcaacaagatggaaaggttcagagactttatggtttggctactgttgctaa

SEQ ID NO: 30344 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaaccagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30345 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaaacagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 30346 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaaacagctcttgaacttgatctcttagaaatcattgctaaagctggacctggtgctcaaatttcacctattgaaattgcttctcagctcccaacaacttagctcattaaactccagaaacccgcggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30347 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttcaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30348 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttcaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30349 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttcaaatcagctcttgaacttgatctcttagaaatcattgctaaagctggacctggtgctcaaatttcacctattgaaattgcttctcagctaccaacaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30350 - DNA, 248 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttatgttggaccgaatgttgcgtctcttggcttgttacaatatcctcacttgttcagttcgtactcaacaagatggaaaggttcagagactttatggtttggctactgttgctaa

SEQ ID NO: 30351 - DNA, 247 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttatgttggaccgaatgttgcgtctcttggcttgttacaatatcctcacttgttcagttcgtactcaacaagatggaaaggttcagagactttatggtttgctactgttgctaa

SEQ ID NO: 30352 - DNA, 248 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttatgttggaccgaatgttgcgtctcttggcttgttacaatatcctcacttgttcagttcgtactcaacaagatggaaaggttcagagactttatgggttggctactgttgctaa

SEQ ID NO: 30353 - DNA, 248 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttatgttggaccgaatgttgcgtctcttggcttgttacaatatcctcacttgttcagttcgtactcaacaagatggaaagattcagagactttatggtttggctactgttgctaa

SEQ ID NO: 30354 - DNA, 248 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttatgttggaccgaatgttgcgtctcttggcttgttacaatatcctcacttgttcagttcgtactcaacaagatggaaaagttcagagactttatggtttggctactgttgctaa

SEQ ID NO: 30355 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaagatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30356 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30357 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaattagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 30358 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaattagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30359 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcggctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 30360 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgacttgttacaatatcctcacttgttctgttcgtactcaacaagatggaaaggttcagagactttatggtttggctactgttgctaa

SEQ ID NO: 30361 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgacttgttacaatatcctcacttgttcagttcgtactcaacaagatggaaaggttcagagactttatggtttggctactgttgctaa

SEQ ID NO: 30362 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgacttgttacaatatcctcacttgttcagttcgtactcaacaagatggaaagattcagagactttatggtttggctactgttgctac

SEQ ID NO: 30363 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgacttgttacaatatcctcacttgttcagttcgtactcaacaagatggaaagattcagagactttatggtttggctactgttgctaa

SEQ ID NO: 30364 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgacttgttacaatatcctcacttgttcagttcgtactcaacaagatggaaaagttcagagactttatggtttggctactgttgctaa

SEQ ID NO: 30365 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaactttatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30366 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttggtctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30367 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctggaccgaatgttgcgtctcttggcttgttacaatatcctcacttgttcagttcgtactcaacaagatggaaaggttcagagactttatggtttggctactgttgctaa

SEQ ID NO: 30368 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctttgaaatcattgctaaagctgtacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagtctttatggtttggctactgtagctaa

SEQ ID NO: 30369 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttggcttgttacaatatcctcacttgttcagttcgtactcaacaagatggaaaggttcagagactttatggtttggctactgttgctaa

SEQ ID NO: 30370 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttataaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30371 - DNA, 294 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30372 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgttaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30373 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgttaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30374 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaatatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30375 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 30376 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30377 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaggctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30378 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaatctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 30379 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagttggaccgaatgttgcgtctcttggcttgttacaatatcctcacttgttcagttcgtactcaacaagatggaaaggttcagagactttatggtttggctactgttgctaa

SEQ ID NO: 30380 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagttggaccgaatgttgcgtctcttggcttgttacaatatcctcacttgttcagttcgtactcaacaagatggaaagattcagagactttatggtttggctactgttgctaa

SEQ ID NO: 30381 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagcttgacctggtgctcaaatttcacctattgaaattgcttctcagctcccaacaactccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30382 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagcttgacctggtgctcaaatttcacctattgaaattgcttctcagctcccaacaactaccagttatgttggaccgaatgttgcgtctcttggcttgttacaatatcctcacttgttcagttcgtactcaacaagatggaaaggttcagagactttatggtttggctactgttgctaa

SEQ ID NO: 30383 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctgtacctggtgctcaaatttcacctgttcaaattgcttctcagctcccaacaactaccggcaacagccgctggaccgtctccagcgccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30384 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctgtacctggtgctcaaatttcacctattgaaattgcttctcagctcccaacaactatgttggaccgaatgttgcgtctcttggcttgttacaatatcctcacttgttcagttcgtactcaacaagatggaaagattcagagactttatggtttggctactgttgctaa

SEQ ID NO: 30385 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggtcctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30386 - DNA, 325 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggagacggtccagcggcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30387 - DNA, 368 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctgttgctcaaatttcacctattgaaattgcttctcagctaccaacaactaaccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30388 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctgtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30389 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggttttcaaatttcacctattgtaattgcttctcagctaccaacaactaagcaccagttatgttggaccgaatgttgcgtctcttggcttgttacaatatcctcacttgttcagttcgtactcaacaagatggaaaggttcagagactttatggtttggctactgttgctaa

SEQ ID NO: 30390 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgttcaaatttcacctattgaaattgcttctcagctcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30391 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgttcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30392 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgttcaaatttcacctattgaaattgcttctcagctaccaacaatatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30393 - DNA, 317 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30394 - DNA, 317 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30395 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgcttaaatttcacctattgaaattgcttctcagctaccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 30396 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcctgatgcaccagttatgttggaccgaatgttgcgtctcttggcttgttacaatatcctcccttgttcagttcttacccaacaagatggaaaggttcagagactttatggtttggctactgttgcaaa

SEQ ID NO: 30397 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30398 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcctgatgcaccagttatgttggaccgaatgttgcgtctcttggcttgttacaatatcctcacttgttcagttcgtactcaacaagatggaaagattcagagactttatggttttgctactgttgctaa

SEQ ID NO: 30399 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaccagttatgttggaccgaatgttgcgtctcttggcttgttacaatatcttcacttgttcagttcgtactcaacaagatggaaaagttcagagactttatggtttggctactgttgctaa

SEQ ID NO: 30400 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaccagttatgttggaccgaatgttgcgtctcttggcttgttacaatatcctcacttgttcagttcgtactcaacaagatggaaaggttcagagactttatggtttggctactgttgctaa

SEQ ID NO: 30401 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaatatgttggaccgaatgttgcgtctcttggcttgttacaatatcctcacttgttctgttcgtactcaacaagatggaaaggttcagagactttatggtttggctactgttgctaa

SEQ ID NO: 30402 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaatatgttggaccgaatgttgcgtctcttggcttgttacaatatcctcacttgttcagttcgtactcaacaagatggaaaagttcagagactttatggtttggctactgttgctaa

SEQ ID NO: 30403 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaatatgttggaccgaatgttgcgtctcttggcttgttacaatatcctcacttgttcagttcgtactcaacaagatggaaaggttcagagactttatggtttggctactgttgctaa

SEQ ID NO: 30404 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttctcctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30405 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttctcctattgaaattgcttctcagctaccaacaacctgatgcaccagttatgttggaccgaatgttgcgtctcttggcttgttacaatatcctcacttgttcagttcgtactcagcaagatggaaaggttcagagactttatggtttggcgactgttgctaa

SEQ ID NO: 30406 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcgcctattgacttgttacaatatcctcacttgttcagttcgtactcaacaagatggaaaggttcagagactttatggtttggctactgttgctaa

SEQ ID NO: 30407 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcgcctattgaaattgcttctcagctcccaacaactatgcaccagttatgttggaccgaatgttgcgtctcttggcttgttacaatatcctcacttgttcagttcgtactcaacaagatggaaagattcagagactttatggtttggctactgttgctaa

SEQ ID NO: 30408 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcgcctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30409 - DNA, 313 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcactgtcaccgaatgttgcgtctcttggcttgttacaatatcctcacttgttctgttcgtactcaacaagatggaaaggttcagagactttatggtttggctactgttgctaa

SEQ ID NO: 30410 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcactgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 30411 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30412 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30413 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcttggcttgttacaatatcctcacttgttcagttcgtactcaacaagatggaaaggttcagagactttatggtttggctactgttgctaa

SEQ ID NO: 30414 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctttgttggaccgaatgttgcgtctcttggcttgttacaatatcctcacttgttctgttcgtactcaacaagatggaaaggttcagagactttatggtttggctactgttgctaa

SEQ ID NO: 30415 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttgcaccagtcatgttggaccgaatgttgcgtctcttggcttgttacaatatcctcacttgttctgttcgtactcaacaagatggaaaggttcagagactttatggtttggcgactgttgctaa

SEQ ID NO: 30416 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30417 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttctaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30418 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaatgcaccagtcatgttggaccgaatgttgcgtctcttggcttgttacaatatcctcacttgttcagttcgtactcaacaagatggaaagattcagagactttatggtttggctactgttgctaa

SEQ ID NO: 30419 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30420 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaatgcaccagtcatgttggaccgaatgttgcgtctcttggcttgttacaatatcctcacttgttctgttcgtactcaacaagatggaaagattcagagactttatggtttggctactgttgctaa

SEQ ID NO: 30421 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaactgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 30422 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30423 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacctgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 30424 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30425 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30426 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttcagttcgtactcaccaagatggaaaggttcagagactttatggtttggctactgttgctaa

SEQ ID NO: 30427 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttcagttcgtactcaacaagatggaaagattcagagactttatggtttggctactgttgctaa

SEQ ID NO: 30428 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 30429 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30430 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30431 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30432 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaaagttcagagactttatggtttgctactgttgctaa

SEQ ID NO: 30433 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 30434 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 30435 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaagtttcagagactttatggtttggctactgttgctaa

SEQ ID NO: 30436 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30437 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30438 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30439 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaatatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30440 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaacttatcccctgattctgtggataaccgtattaccgcctttgagtgagccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30441 - DNA, 409 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaacttatcccctgattctggggataaccgtattaccgccgttgagtgagccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30442 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30443 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30444 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30445 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30446 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 30447 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30448 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaggcgctggagacggtgcaggcgctgttgccggtgctgtgccaggcccacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30449 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaccagtcatgttggaccgaatgttgcgtctcttggcttgttacaatatcctcacttgttcagttcgtactcaacaagatggaaagattcagagactttatggtttggctactgttgctaa

SEQ ID NO: 30450 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaccagtcatgttggaccgaatgttgcgtctcttggcttgttacaatatcctcacttgttcagttcgtactcaacaagatggaaaagttcagagactttatggtttggctactgttgctaa

SEQ ID NO: 30451 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaccagtcatgttggaccgaatgttgcgtctcttggcttgttacaatatcctcacttgttctgttcgtactcaacaagatggaaagattcagagactttatggtttggctactgttgctaa

SEQ ID NO: 30452 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaccagtcatgttggaccgaatgttgcgtctcttggcttgttacaatatcctcacttgttcagttcgtactcaacaagatggaaaggttcagagactttatggtttggctactgttgctaa

SEQ ID NO: 30453 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaacctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 30454 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30455 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaactaaccgcaaaaaggccatccgtcaggatggccttctgcttagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30456 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaacgtactcaacaagatggaaaggttcagagactttatggtttggctactgttgctaa

SEQ ID NO: 30457 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaacgtactcaacaagatggaaaggttcagagactttatggtttggctactgttgcgaa

SEQ ID NO: 30458 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30459 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30460 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30461 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30462 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatgggaagattcagagactttatggtttggctactgttgctaa

SEQ ID NO: 30463 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30464 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 30465 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaaccagtcatgttggaccgaatgttgcgtctcttggcttgttacaatatcctcacttgttcagttcgtactcaacaagatggaaagattcagagactttatggtttggctactgttgctaa

SEQ ID NO: 30466 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaaccagtcatgttggaccgaatgttgcgtctcttggcttgttacaatatcctcacttgttctgttcgtactcaacaagatggaaaggttcagagactttatggtttggctactgttgctaa

SEQ ID NO: 30467 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaaccagtcatgttggaccgaatgttgcgtctcttggcttgttacaatatcctcacttgttcagttcgtactcaacaagatggaaaggttcagagactttatggtttggctactgttgctaa

SEQ ID NO: 30468 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaaactgatgcaccagtcatgttggaccgaatgttgcgtctcttggcttgttacaatatcctcacttgttctgttcgtactcaacaagatggaaaggttcggagactttatggtttggctactgttgctaa

SEQ ID NO: 30469 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30470 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30471 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30472 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30473 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30474 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacatgttggaccgaatgttgcgtctcttggcttgttacaatatcctcacttgttcagttcgtactcaacaagatggaaagattcagagactttatggtttggctactgttgctaa

SEQ ID NO: 30475 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30476 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30477 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30478 - DNA, 404 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactggggtcaagccgtgggcctggcacagcaccggcaacagccgctggatgcaccagttatgttggaccgaatgttgcgtctcttggcttgttacaatatcctcacttgttcagttcgtactcaacaagatggaaagattcagagactttatggtttggctactgttgctaa

SEQ ID NO: 30479 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30480 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30481 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30482 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactgatgcaccagtcatgttggaccgaatgttgcgtctcttggcttgttacaatatcctcactttttctgttcgtactcaacaagatggaaaggttcagagactttatggtttggctactgttgctaa

SEQ ID NO: 30483 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactatgcaccagttatgttggaccgaatgttgcgtctcttggcttgttacaatatcctcacttgttcggttcgtactcaacaagatggaaaggttcagagactttatggtttggctactgttgctaa

SEQ ID NO: 30484 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaccggcaacagccgctggaccgtctccagcaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30485 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 30486 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30487 - DNA, 461 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaacaacacggatggcctttttgcgtttctacaaactcttcctggctagcggtacgcgtattaattgcgttgcgctcactgcccgctttccagtcgggaaacctgtcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30488 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctcccaaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30489 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30490 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30491 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30492 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30493 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacacgcaccagttatgttggaccgaatgttgcgtctcttggcttgttacaatatcctcgcttgttcagttcgtactcaacaagatggaaaggttcagagactttatggtttggctactgtggctaa

SEQ ID NO: 30494 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaccagttatgttggaccgaatgttgcgtctcttggcttgttacaatatcctcacttgttcagttcgtactcaacaagatggaaagattcagagactttatggtttggctactgttgctaa

SEQ ID NO: 30495 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30496 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30497 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30498 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaactcatgcaccagttatgttggaccgaatgttgcgtctcttggcttgttacaatatcctcacttgttcagttcgtactcaacaagatggaaagattcagagactttatggtttggctactgttgctaa

SEQ ID NO: 30499 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30500 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaacaccagttatgttggaccgaatgttgcgtctcttggcttgttacaatatcctcacttgttcagttcgtactcaacaagatggaaaagttcagagactttatggtttggctactgttgctaa

SEQ ID NO: 30501 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30502 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaaatgcaccagttatgttggaccgaatgttgcgtctcttggcttgttacaatatcctcacttgttcagttcgtactcaacaagatggaaagattcagagactttatggtttggctactgttgcta

SEQ ID NO: 30503 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcgtctcttggcttgttacaatatcctcacttgttctgttcgtactcaacaagatggaaaggttcagagactttatggtttggctactgttgctaa

SEQ ID NO: 30504 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30505 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30506 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattggaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30507 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgagattgcttctcagctcccaacaactttgtgcacgacgacatcattccgtggcgttatccctgatgcaccagttatgttggaccgaatgttgcgtctcttggcttgttacaatatcctcacttgttcagttcgtactcaacaagatggaaagattcagagactttaaggtttggctactgttgctaa

SEQ ID NO: 30508 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgagattgcttctcagctcccaacaactgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 30509 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgacttgttacaatatcctcacttgttctgttcgtactcaacaagatggaaagattcagagactttatggtttggctactgttgctaa

SEQ ID NO: 30510 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgacttgttacaatatcctcacttgttcagttcgtactcaacaagatggaaaggttcagagactttatggtttggctactgttgctaa

SEQ ID NO: 30511 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgacttgttacaatatcctcacttgttcagttcgtactcaacaagatggaaagattcagagactttatggtttggctactgttgctaa

SEQ ID NO: 30512 - DNA, 337 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30513 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30514 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgtttctcagctcccaacaaccagttatgttggaccgaatgttgcgtctcttggcttgttacaatatcctcacttgttcagttcgtactcaacaagatggaaaggttcagagactttatggtttggctactgttgctaa

SEQ ID NO: 30515 - DNA, 296 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgttacaatatcctcacttgttcagttcgtactcaacaagatggaaaagttcagagactttatggtttggctactgttgctaa

SEQ ID NO: 30516 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttggcagctcccaacaactgatgcaccagttatgttggaccgaatgttgcgtctcttggcttgttacaatatcctcacttgttcagttcgtactcaacaagatggaaaggtttagagactttatggtttggctactgttgctaa

SEQ ID NO: 30517 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttcttggaccgaatgttgcgtctcttggcttgttacaatatcctcacttgttcagttcgtactcaacaagatggaaagattcagagactttatggtttggctactgttgctaa

SEQ ID NO: 30518 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcggctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30519 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcggctaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30520 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcggctaccaacaactcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30521 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcaggatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30522 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctttcgccaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30523 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctttcgccaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30524 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30525 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30526 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaatatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30527 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaatatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30528 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30529 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaccctgatgcaccagtcatgttggaccgaatgttgcgtctcttggcttgttacaatatcctcacttgttctgttcgtactcaacaagatggaaagattcagagactttatggtttggctactgttgcta

SEQ ID NO: 30530 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30531 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaacgtactcaacaagatggaaaggttcagagactttatggtttggctactgttgctaa

SEQ ID NO: 30532 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30533 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30534 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30535 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaacctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 30536 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30537 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcttccaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30538 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctgcaccagttatgttggaccgaatgttgcgtctcttggcttgttacaatatcctcacttgttcagttcgtactcaacaagatggaaaggttcagagactttatggtttggctactgttgctaa

SEQ ID NO: 30539 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30540 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30541 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30542 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30543 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30544 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 30545 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30546 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30547 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30548 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccgacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30549 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30550 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30551 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30552 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30553 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30554 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 30555 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagtctttatggtttggctactgttgctaa

SEQ ID NO: 30556 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30557 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcgacaagatggaaagattcagagactttatggtttggctactgttgcta

SEQ ID NO: 30558 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30559 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgctcagttcgtactcaacaagatggaaaggttcagagactttatggtttggctactgttgctaa

SEQ ID NO: 30560 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30561 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30562 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30563 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 30564 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30565 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaagttatgttggaccgagtgttgcgtctcttggcttgttacaatatcctcccttgttcagttcgtactcaacaagatggaaacgtccagagcctttaccgtttggctactgttgctaa

SEQ ID NO: 30566 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaagttatgttggaccgaatgttgcgtctcttggcttgttacaatatcctcacttgttcagttcgtactcaacaagatggaaagattcagagactttatggtttggctactgttgctaa

SEQ ID NO: 30567 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaagttatgttggaccgaatgttgcgtctcttggcttgttacaatatcctcacttgttcagttcgtactcaacaagatggaaaggttcagagactttatggtttggctaccgttgctaa

SEQ ID NO: 30568 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 30569 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30570 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30571 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30572 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttgtaccgaatgttgcgtctcttggcttgttacaatatcctcacttgttcagttcgtactcaacaagatggaaagattcagagactttatggttttgctactgttgctaa

SEQ ID NO: 30573 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggatcgaatgttgcgtctcttggcttgttacaatatcctcacttgttcagttcgtactcaacaagatggaaagattcagagactttatggtttggctactgttgctaa

SEQ ID NO: 30574 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30575 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30576 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30577 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30578 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgcta

SEQ ID NO: 30579 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 30580 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30581 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30582 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaactagatgcaccagttatgttggaccgaatgttgcgtctcttggcttgttacaatatcctcacttgttcagttcgtactcaacaagatggaaagattcagagactttatggtttggctactgttgctaa

SEQ ID NO: 30583 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaactactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30584 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacgtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30585 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttcagttcgtactcaacaagatggaaagattcagagactttatggtttggctactgttgctaa

SEQ ID NO: 30586 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttcagttcgtactcaacaagatggaaaagttcagagactttatggtttggctactgttgctaa

SEQ ID NO: 30587 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacgcaccagttatgttggaccgaatgtcgcgtctcttggcttgttacaatatcctcacttgttcagttcgtactcaacaagatggaaaggttcagagactttatggtttggctactgttgctaa

SEQ ID NO: 30588 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 30589 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30590 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30591 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30592 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30593 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30594 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30595 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 30596 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30597 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30598 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30599 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacccaccagttatgttggaccgaatgttgcgtctcttggcttgttacaatatcctcacttgttcagttcgtactcaacaagatggaaaggttcagagactttatggtttggctactgttgctaa

SEQ ID NO: 30600 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaaccagttatgttggaccgaatgttgcgtctcttggcttgttacaatatcctcacttgttcagttcgtactcaacaagatggaaaggttcagagactttatggtttggctactgttgctaa

SEQ ID NO: 30601 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaaccagttatgttggaccgaatgttgcgtctcttggcttgttacaatatcctcacttgttcagttcgtactcaacaagatggaaagattcagagactttatggtttggctactgttgctaa

SEQ ID NO: 30602 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatttatgttggaccgaatgttgcgtctcctggcttgttacaatatcctcacttgttgtgttcgtactcaacaagatggaaaggttcagaggctttatgggttggctaactgttgctaa

SEQ ID NO: 30603 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatttatgttggaccgaatgttgcgtctcttggcttgttacaatatcctcacttgttcagttcgtactcaacaagatggaaaagttcagagactttatggtttggctactgttgctaa

SEQ ID NO: 30604 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 30605 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30606 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaaaatggaaagattcagagactttatggtttggctactgttgctaa

SEQ ID NO: 30607 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgtttctaa

SEQ ID NO: 30608 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30609 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagcctttatggtttggctactgttgctaa

SEQ ID NO: 30610 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30611 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggatcgaatgttgcgtctcttggcttgttacaatatcctcacttgttctgttcgtactcaacaagatggaaaggttcagagactttatggtttggctactgttgctaa

SEQ ID NO: 30612 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30613 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30614 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30615 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaagattcagagactttatggtttggctactgttgcta

SEQ ID NO: 30616 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30617 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30618 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacatatgttggaccgaatgttgcgtctcttggcttgttacaatatcctcacttgttcagttcgtactcaacaagatggaaaggttcagagactttatggtttggctactgttgctaa

SEQ ID NO: 30619 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacagttggaccgaatgttgcgtctcttggcttgttacaatatcctcacttgttcagttcgtactcaacaagatggaaaggttcagagactttatggtttggctactgttgctaa

SEQ ID NO: 30620 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacagttggaccgaatgttgcgtctcttggcttgttacaatatcctcacttgttcagttcgtactcaacaagatggaaaagttcagagactttatggtttggctactgttgctaa

SEQ ID NO: 30621 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatggaaaagttcagagactttatggtttggctactgttgctaa

SEQ ID NO: 30622 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatggaaaggttcagagactttatggtttggctactgttgctaa

SEQ ID NO: 30623 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatggaaagattcagagactttatggtttggctactgttgctaa

SEQ ID NO: 30624 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacagccagcaatggcggcggcaggccggcgctggagactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30625 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacagatgtaccagttatgttggaccgaatgttgcgtctcttggcttgttacaatatcctcacttgttcagttcgtactcaacaagatggaaaggttcagagactttatggtttggctactgttgctaa

SEQ ID NO: 30626 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30627 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30628 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 30629 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 30630 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 30631 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacagatgcaccagtcatgttggaccgaatgttgcgtctcttggcttgttacaatatcctcacttgttctgttcgtactcaacaagatggaaaagttcagagactttatggtttggctactgttgctaa

SEQ ID NO: 30632 - DNA, 405 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacagactgggcctttcgttttatctgttgtttgttggtgaacgctctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30633 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30634 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30635 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30636 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggcttgttgctaa

SEQ ID NO: 30637 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30638 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30639 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30640 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaagattcagagactttatggtttggctactgttgcta

SEQ ID NO: 30641 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30642 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30643 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30644 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaccccagcaggtggtggccatcgccagcaatggcggtggcaagcaggcgctggagacggtccagcggctgttgccggtgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30645 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaccccagcagggggtggccatcgccagcaatggcggtggcaagcaggcgctggaaacggtccagcggctgttgccggtgcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30646 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaccagttatgttggaccgaatgttgcgtctcttggcttgttacaatatcctcacttgttcagttcgtactcaacaagatggaaaggttcagagactttatggtttggctactgttgctaa

SEQ ID NO: 30647 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaccagttatgttggaccgaatgttgcgtctcttggcttgttacaatatcctcacttgttcagttcgtactcaacaagatggaaagattcagagactttatggtttggctactgttgctaa

SEQ ID NO: 30648 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaccagttatgttggaccgaatgttgcgtctcttggcttgttacaatatcctcacttgttcagttcgtactcaacaagatggaaaggttcagagcctttatggtttggctactgttgctaa

SEQ ID NO: 30649 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaattatgttggaccgaatgttgcgtctcttggcttgttacaatatcctcacttgttcagttcgtactcaacaagatggaaaggttcagagactttatggtttggctactgttgctaa

SEQ ID NO: 30650 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgttggaccgaatgttgcgtctcttggcttgttacaatatcctcacttgttcagttcgtactcaacaagatggaaaggttcagagactttatggtttggctactgttgctaa

SEQ ID NO: 30651 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgttggaccgaatgttgcgtctcttggcttgttacaatatcctcacttgttcagttcgtactcaacaagatggaaaagttcagagactttatggtttggctactgttgtaa

SEQ ID NO: 30652 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 30653 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30654 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30655 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30656 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggtactgttgctaa

SEQ ID NO: 30657 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30658 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30659 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30660 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttgaccgaatgttgcgtctcttggcttgttacaatatcctcacttgttcagttcgtactcaacaagatggaaaggttcagagactttatggtttggctactgttgctaa

SEQ ID NO: 30661 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30662 - DNA, 335 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatatgttgcgtctcttggcttgttacaatatcctcacttgttcagttcgtactcaacaagatggaaagattcagagactttatggtttggctactgttgctaa

SEQ ID NO: 30663 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30664 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 30665 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30666 - DNA, 277 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaagatggaaagattcagagactttatggtttggctactgttgctaa

SEQ ID NO: 30667 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30668 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 30669 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgtgcagttcgtactcaacaagatggaaagattcagagactttatggtttggctactgttgctaa

SEQ ID NO: 30670 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30671 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactttatgttggaccgaatgttgcgtctcttggcttgttacaatatcctcacttgttcagttcgtactcaacaagatggaaaggttcagagactttatggtttggctactgttgctaa

SEQ ID NO: 30672 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactttatgttggaccgaatgttgcgtctcttggcttgttacaatatcctcacttgttcagttcgtactcaacaagatggaaagattcagagactttatggtttggctactgttgctaa

SEQ ID NO: 30673 - DNA, 477 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacttggcaagcaggcgctggagacggcccagcggctgttgccggtgctgtgccaggcccacggcttgaccccggagcaggtggtggccatcgccagccacgatggcggcaagcaggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30674 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacttgcgtctcttggcttgttacaatatcctcacttgttcagttcgtactcaacaagatggaaagattcagagactttatggtttggctactgttgctaa

SEQ ID NO: 30675 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacttgcgtctcttggcttgttacaatatcctcacttgttcagttcgtactcaacaagatggaaaggttcagagactttatggtttggctactgttgctaa

SEQ ID NO: 30676 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacttgccggtgctgtgccaggcccacggcttgaccccggagcaggtggctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30677 - DNA, 407 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacttgccggtgctgtgccaggcccacggcttgaccccggagcaggtggctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30678 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30679 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggttcggctactgttgctaa

SEQ ID NO: 30680 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacttatgttggaccgaatgttgcgtctcttggcttgttacaatatcctcacttgttcagttcgtactcaacaagatggaaagattcagagactttatggtttggctactgttgctaa

SEQ ID NO: 30681 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacttatgttggaccgaatgttgcgtctcttggcttgttacaatatcctcacttgttcagttcgtactcaacaagatggaaaagttcagagactttatggtttggctactgttgctaa

SEQ ID NO: 30682 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacttagctcattaaactccagaaacccgcggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30683 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacttagctcattaaactccagaaacccgcggccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30684 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgttggaccgaatgttgcgtctcttggcttgttacaatatcctcacttgttcagttcgtactcaacaagatggaaaggttcagagactttatggtttggctactgttgctaa

SEQ ID NO: 30685 - DNA, 346 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgttggaccgaatgttgcgtctcttggcttgttacaatatcctcacttgttcagttcgtactcaacaagatggaaaagttcagagactttatggtttggctactgttgctaa

SEQ ID NO: 30686 - DNA, 404 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactggggtcaagccgtgggccgggcccagcaccggcaacagccgctggatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30687 - DNA, 391 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactggcacagcaccggcaacagccgctggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30688 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactggaccgaatgttgcgtctcttggcttgttacaatatcctcacttgttcagttcgtactcaacaagatggaaaggttcagagactttatggtttggctactgttgctaa

SEQ ID NO: 30689 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgcaccagttatgttggaacgaaagttgcggctcttggcttgttacaataacctcacttgttcagttcgtactcaacaagatggaaaggttcagagactttatggtttggctactgttgctaa

SEQ ID NO: 30690 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30691 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30692 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctatgttgctaa

SEQ ID NO: 30693 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30694 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30695 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttcgcttgttacaatatgctcgcttgttcaattcgtgctcaacaagatgaaaagattcagagactttatggtttggctactgttgctaa

SEQ ID NO: 30696 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttgctactgttgctaa

SEQ ID NO: 30697 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 30698 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatattgcgtctcttggcttgttacaatatcctcacttgttcagttcgtactcaacaagatggaaaggttcagagactttatggtttggctactgttgctaa

SEQ ID NO: 30699 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtttcttggcttgttacaatatcctcacttgttcagttcgtactcaacaagatggaaaggttcagagactttatggtttggctactgttgctaa

SEQ ID NO: 30700 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 30701 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgtttagttcgtactcaacaagatggaaaggttcagagactttatggtttggctactgttgctaa

SEQ ID NO: 30702 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttaagttcgtactcaacaagatggaaagattcagagactttatggtttggctactgttgcta

SEQ ID NO: 30703 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaataagatggaaagattcagagactttatggtttggctactgttgctaa

SEQ ID NO: 30704 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatccacacttgttcagttcgtactcaacaagatggaaagattcagagactttatggtttggctactgttgctaa

SEQ ID NO: 30705 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttaagttcgtactcaacaagatggaaaagttcagagactttatggtttggctactggtgctaa

SEQ ID NO: 30706 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 30707 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgatacaatatcctcacttgttcagttcgtactcaacaagatggaaagattcagagactttatggtttggctactgttgctaa

SEQ ID NO: 30708 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 30709 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttacgttggaccgaatgttgcgtctcttggcttgttacaatatcctcacttgttcagttcgtactcaacaagatggaaaggttcagagactttatggtttggctactgttgctaa

SEQ ID NO: 30710 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 30711 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgagcctttcgttttatctgttgtttgtcggtgaacgctctcctgagtaggacaaatccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30712 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgagcctttcgttttatctgttgtttgtcggtgaacgctctcctgagtaggacaaatccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30713 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgagcctttcgttttatctgttgtttgtcggtgaacgctctcctgagtaggacaaatccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30714 - DNA, 433 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgacggtccagcggctgttggcggtgctgtgccaggcccacggcttgaccccggagcaggtggtggccatcgctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30715 - DNA, 433 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgacggtccagcggctgttgccggtgctgtgccaggcccacggcttgaccccggagcaggtggtggccatcgctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30716 - DNA, 433 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgacggtccagcggctgttgccggtgctgtgccaggcccacggcttgaccccggagcaggtggtggccatcgctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30717 - DNA, 387 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactcttcctggctagcggtacgcgtaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30718 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30719 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccaaatgttgcgtctcttggcttgttacaatatcctcacttgttcagttcgtactcaacaagatggaaaggttcagagactttatggtttggctactgttgctaa

SEQ ID NO: 30720 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30721 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30722 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 30723 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactcaccagttatgttggaccgaatgttgcgtctcttggcttgttacaatatcctcacttgttcagttcgtactcaacaagatggaaaggttcagagactttatggtttggctactgttgctaa

SEQ ID NO: 30724 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactatgttggaccgaatgttgcgtctcttggcttgttacaatatcctcacttgttcagttcgtactcaacaagatggaaagattcagagactttatggtttggctactgttgctaa

SEQ ID NO: 30725 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactatgttggaccgaatgttgcgtctcttggcttgttacaatatcctcacttgttcagttcgtactcaacaagatggaaaggttcagagactttatggtttggctactgttgctaa

SEQ ID NO: 30726 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactatgttgcgtctcttggcttgttacaatatcctcacttgttcagttcgtactcaacaagatggaaaggttcagagactttatggtttggctactgttgctaa

SEQ ID NO: 30727 - DNA, 439 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactatgccggtgctgtgccaggcccacggcttgaccccggagcaggtggtggccatcgccagccacgatggcggcaagcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30728 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30729 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaagattcagagactttatggtttggctactgatgctaa

SEQ ID NO: 30730 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30731 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaggccgacgaagtgcagaggtacgtggaggagaaccagaccagcagcacgcacaaccaccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30732 - DNA, 419 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactagctggaccgtctccagcgcctgcttgccgccatcgtggctggcgatggccaccaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30733 - DNA, 419 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactagctggaccgtctccagcgcctgcttgccgccatcgtggctggcgatggccaccaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30734 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactagcaccagttatgttggaccgaatgttgcgtctcttggcttgttacaatatcctcacttgttcagttcgtactcaacaagatggaaaggttcagagactttatggtttggctactgttgctaa

SEQ ID NO: 30735 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30736 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30737 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30738 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30739 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30740 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaccggcaacagccgctggaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30741 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaccggcaacagccgctggaccgtctccagcaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30742 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaccggcaacagccgctggaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30743 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaccgaatgttgcgtctcttggcttgttacaatatcctcacttgttcagttcgtactcaacaagatggaaaggttcagagactttatggtttggctactgttgctaa

SEQ ID NO: 30744 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaccgaatgttgcgtctcttggcttgttacaatatcctcacttgttctgttcgtactcaacaagatggaaaggttcagagactttatggtttggctactgttgctaa

SEQ ID NO: 30745 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30746 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30747 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaccagttatgttggaccgaatgttgcgtctcttggcttgttacaatatcctcacttgttcagttcgtactcaacaagatggaaaggttcagagactttatggtttggctactgttgctaa

SEQ ID NO: 30748 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaccagttatgttggaccgaatgttgcgtctcttggcttgttacaatatcctcacttgttcagttcgtactcaacaagatggaaagattcagagactttatggtttggctactgttgctaa

SEQ ID NO: 30749 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaattatgttggaccgaatgttgcgtctcttggcttgttacaatatcctcacttgttcagttcgtactcaacaagatggaaaggttcagagactttatggtttggctactgttgctaa

SEQ ID NO: 30750 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttgggccgaatgttgcgtctcttggcttgttacaatatcctcacttgttcagttcgtactcaacaagatggaaaggttcagagactttatggtttggctactgttgctaa

SEQ ID NO: 30751 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 30752 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgatacaatatcctcacttgttcagttcgtactcaacaagatggaaaggttcagagactttatggtttggctactgttgctaa

SEQ ID NO: 30753 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctctcttgttcagttcgtactcaacaagatggaaagattcagagactttatggtttggctactgttgctaa

SEQ ID NO: 30754 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30755 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaagtatcaggacatgatcgcagcgttgccagagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30756 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaagtatcaggacatgatcgcagcgttgccagagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30757 - DNA, 397 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaggcgcagcggtcgggctgaacggggggttaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30758 - DNA, 434 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaacggtcaccgtaaccagcaaatcaatatcactgtgtggcttcaggccgccatccactgcggagccgtacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30759 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaacggggtcaagccgtgggcctggcacagcaccggcaccagccgctggaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30760 - DNA, 425 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaacggggtcaagccgtgggcctggcacagcaccggcaacagccgctggaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30761 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaacctgggcggctccaggaagcccgacggcgccatctacaccgtgggctcccccatcgactacggcgtgatcgtggacaccaaggcctactccggcggctacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30762 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30763 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaacctgatgcaccagttatgttggaccgaatgtttcgtctcttggcttgttacaatatcctcacttgttcagttcgtactcaacaagatggaaagattcagagactttatggtttggctactgttgctaa

SEQ ID NO: 30764 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30765 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccggtgctgtgccaggcccacggcttgaccccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30766 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccggcaacagccgctggaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30767 - DNA, 454 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccgccatcgtggcgggcgatggcccccccctcccccggggtcaagccgtgggcctggcacagcaccggcaacagccgctggaccgtctccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30768 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccctatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30769 - DNA, 368 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30770 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaaggttcagagactttatggtttggctactgttgctaa

SEQ ID NO: 30771 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaagattcagagactttatggtttggctactgttgctaa

SEQ ID NO: 30772 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcatactcaacaagatggaaagattcagagactttatggtttggctactgttgctaa

SEQ ID NO: 30773 - DNA, 457 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccaggcccacggcttgaccccccagcaggtggtggccatcgccagcaatggcggtggcaagcaggcgctggagacggtccagcggctgttgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30774 - DNA, 392 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccacgatggcggcaacagccgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30775 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccaccagttatgttggaccgaatgttgcgtctcttggcttgttacaatatcctcacttgttcagttcgtactcaacaagatggaaaggttcagagactttatggtttggctactgttgctaa

SEQ ID NO: 30776 - DNA, 460 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccaatgaaaaggggcagccgccacccatgaaatatataggacccctataggactcatgtgcatattaaccgtttgccacccatgctttcatatccactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30777 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30778 - DNA, 370 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30779 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30780 - DNA, 465 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaagcaacaatgctcgccagcgccggcctgccgccgccattgctggcgatggccaccacctgctgaggggtcaagccgtgggcctggcacagcaccggcaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30781 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactaaaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30782 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttcagttcgtactcaacaagatggaaaggttcagagactttatggtttggctactgttgctaa

SEQ ID NO: 30783 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacgttatgttggaccgaatgttgcgtctcttggcttgttacaatatcctcacttgttcagttcgtactcaacaagatggaaaagttcagagactttatggtttggctactgttgctaa

SEQ ID NO: 30784 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacgttatgttggaccgaatgttgcgtctcttggcttgttacaatatcctcacttgttcagttcgtactcaacaagatggaaaggttcagagactttatggtttggctactgttgctaa

SEQ ID NO: 30785 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacgtactcaacaagatggaaaggttcagagactttatggtttggctactgttgctaa

SEQ ID NO: 30786 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacgcagtggaggcagtgcatgcatggcgcaatgcactgggcggggtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30787 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30788 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30789 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacgatgcaccagttaagttggaccgaatgttgcgtctcttggcttgttacaatatcctcacttgttcagttcgtactcaacaagatggaaaggttcagagactttatggtttggctactgttgctaa

SEQ ID NO: 30790 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgattcaccagttatgttggaccgaatgttgcgtctcttggcttgttacaatatcctcacttgttcagttcgtactcaacaagatggaaaggttcagagactttatggtttggctactgttgctaa

SEQ ID NO: 30791 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30792 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30793 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30794 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtacttaacaagatggaaaggttcagagactttatggtttggctactgttgctaa

SEQ ID NO: 30795 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30796 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttctgttcgtactcaacaagatggaaaggttcagagcctttatggtttggctactgttgctaa

SEQ ID NO: 30797 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatccccacttgttcagttcgtactcaacaagatggaaaggttcagagactttatggtttggctactgttgctaa

SEQ ID NO: 30798 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 30799 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttgacttgttacaatatcctcacttgttcagttcgtactcaacaagatggaaagattcagagactttatggtttggctactgttgctaa

SEQ ID NO: 30800 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggacctaatgttgcgtctcttggcttgttacaatatcctcacttgttcagttcgtactcaacaagatggaaagattcagagactttatggtttggctactgttgctaa

SEQ ID NO: 30801 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttgggccgaatgttgcgtctcttggcttgttacaatatcctcacttgttcagttcgtactcaacaagatggaaagattcagagactttatggtttggctactgttgctaa

SEQ ID NO: 30802 - DNA, 408 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccgtgggcctggcacagcagcggcgacagcgcctgcaccgtctccagccctgatgcaccagttatgttggaccgaatgttgcgtctcttggcttgttacaatatcctcacttgttcagttcgtactcaacaagatggaaagattcagagactttatggtttggctatgttgctaa

SEQ ID NO: 30803 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30804 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30805 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30806 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30807 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgagtgttgcgtctcttggcttgttacaatatcctcgcttgttcagttcgtactcaacaagatggaaagattcagagactttatggtttggctactgttgctaa

SEQ ID NO: 30808 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 30809 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagagggaaaggttcagagactttatggtttggctactgttactaa

SEQ ID NO: 30810 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctctcggcttgttacaatatcctcacttgttcagttcgtactcaacaagatggaaaggttcagagactttatggtttggctactgttgctaa

SEQ ID NO: 30811 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 30812 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgagtctcttggcttgttacaatatcctcacttgttcagttcgtactcaacaagatggaaagattcagagactttatggtttggctactgttgctaa

SEQ ID NO: 30813 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgtagcgtctcttggcttgttacaatatcctcacttgttcagttcgtactcaacaagatggaaagattcagagactttatggtttggctactgttgctaa

SEQ ID NO: 30814 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcatactcaacaagatggaaagattcagagactttatggtttggctactgttgctaa

SEQ ID NO: 30815 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtattcaacaagatggaaagattcagagactttatggtttggcactgttgctaa

SEQ ID NO: 30816 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaacgaatgttgcgtctcttggcttgttacaatatcctcacttgttcagttcgtactcaacaagatggaaaggttcagagactttatggtttggctactgttgctaa

SEQ ID NO: 30817 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 30818 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30819 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30820 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30821 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30822 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccagttatgttggaccgaatgttgcgtctcttggcttgttacaatatcctcacttgttcagttcgtactcaacaagatggaaagattcagagactttatggtttggctactgttgctaa

SEQ ID NO: 30823 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccaggccgacgaaatgcagaggtacgtggaggagaaccagaccaggaacaagcacatcacccccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30824 - DNA, 424 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccaggccgacgaaatgcagaggtacgtggaggagaaccagaccaggaacaagcacatcaaccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30825 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacatgttggaccgaatgttgcgtctcttggcttgttacaatatcctcacttgttctgttcgtactcaacaagatggaaaggttcagagactttatggtttggctactgttgctaa

SEQ ID NO: 30826 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacatgttggaccgaatgttgcgtctcttggcttgttacaatatcctcacttgttcagttcgtactcaacaagatggaaaggttcagagactttatggtttggctactgttgctaa

SEQ ID NO: 30827 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 30828 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30829 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaagattcagagcctttatggtttggctactgttgctaa

SEQ ID NO: 30830 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30831 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacagttatgttggaccgaatgttgcgtctcttggcttgttacaatatcctcacttgttcagttcgtactcaacaagatggaaaggttcagagactttatggtttggctactgttgctaa

SEQ ID NO: 30832 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 30833 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30834 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacagataccaaatactgttcttctagtgtagccgtagttaggccaccacttcaagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30835 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacacgcaattaatacgcgtaccgctagccaggaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30836 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacacgcaattaatacgcgtaccgctagccaggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30837 - DNA, 455 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacaccccccagcaggtggtggccatcgccagcaataatggtggcaagcaggcgctggagacggtccagcggctgttgccggtgctgtgccaggcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30838 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaatattcagagactttatggtttggctactgttgctaa

SEQ ID NO: 30839 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30840 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgtggcgtctcttggcttgttacaatatcctcacttgttcagttcgtactcaacaagatggaaagattcagagactttatggtttggctactgttgctaa

SEQ ID NO: 30841 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagattgaaaggttcagagactttatggtttggctactgttgctaa

SEQ ID NO: 30842 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30843 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaatacaccagttatgttggaccgaatgttgcgtctcttggcttgttacaatatcctcacttgttctgttcgtactcaacaagatggaaaggttcagagactttatggtttggctactgttgctaa

SEQ ID NO: 30844 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30845 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 30846 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30847 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30848 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaaatgcaccggttatgttggaccgaatgttgcgtctcttggcttgttacaatatcctcacttgttcagttcgtactcaacaagatggaaagattcagagactttatggtttggctactgttgctaa

SEQ ID NO: 30849 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 30850 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 30851 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaaggttcagagactttatgggttggctactgttgctaa

SEQ ID NO: 30852 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30853 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30854 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaaatgatgcaccagttatgttggaccgaatgtttcgtctcttggcttgttacaatatcctcacttgttcagttcgtactcaacaagatggaaaggttcagagactttatggtttggctactgttgctaa

SEQ ID NO: 30855 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30856 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30857 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 30858 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30859 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctccagttatgttggaccgaatgttgcgtctcttggcttgttacaatatcctcacttgttcagttcgtactcaacaagatggaaagattcagagactttatggtttggctactgttgctaa

SEQ ID NO: 30860 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctccagttatgttggaccgaatgttgcgtctcttggcttgttacaatatcctcacttgttcagttcgtactcaacaagatggaaagattcagagactttatggtttggtactgttgctaa

SEQ ID NO: 30861 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctccagttatgttggaccgaatgttgcgtctcttggcttgttacaatatcctcacttgttcagttcgtactcaacaagatggaaaggttcagagactttatggtttggctactgttgctaa

SEQ ID NO: 30862 - DNA, 277 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctccaaacaagatggaaagattcagagactttatggtttggctactgttgctaa

SEQ ID NO: 30863 - DNA, 300 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcatcctcacttgttcagttcgtactcaacaagatggaaagattcagagactttatggtttggctactgttgctaa

SEQ ID NO: 30864 - DNA, 300 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcatcctcacttgttcagttcgtactcaacaagatggaaaagttcagagactttatggtttggctactgttgctaa

SEQ ID NO: 30865 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctatgttggaccgaatgttgcgtctcttggcttgttacaatatcctcacttgttcagttcgtactcaacaagatggaaaagttcagagactttatggtttggctactgttgctaa

SEQ ID NO: 30866 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctatgttggaccgaatgttgcgtctcttggcttgttacaatatcctcacttgttcagttcgtactcaacaagatggaaaggttcagagactttatggtttggctactgttgctaa

SEQ ID NO: 30867 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaagattcagagactttatggtttggctactgttgctaa

SEQ ID NO: 30868 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30869 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcgacaagatggaaaggttcagagactttatggtttggctactgttgctaa

SEQ ID NO: 30870 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctatgcaccagttatgttggaccgaatgttgcgtctcttggattgttaaaatataataaaggggtaagttagtactcaacaagatggaaagattcagagactttatggtttggctactgttgctaa

SEQ ID NO: 30871 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggatcgaatgttgcgtctcttggcttgttacaatatcctcacttgttcagttcgtactcaacaagatggaaaggttcagagactttatggtttggctactgttgctaa

SEQ ID NO: 30872 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30873 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtacccaacaagatggaaaagttcagagactttatggtttggctactgttgctaa

SEQ ID NO: 30874 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30875 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaatggttcagagactttatggtttggctactgttgctaa

SEQ ID NO: 30876 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 30877 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctacctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30878 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30879 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccgacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30880 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30881 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30882 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccctatgcaccagttatgttggaccgaatgttgcgtctcttggcttgttacaatatcctcacttgttcagttcgtactcaacaagatggaaagattcagagactttatggtttggctactgttgctaa

SEQ ID NO: 30883 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30884 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30885 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30886 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccagttatgttggaccgaatgttgcgtctcttggcttgttacaatatcctcacttgttcagttcgtactcaacaagatggaaagattcagagactttatggtttggctactgttgctaa

SEQ ID NO: 30887 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccagttatgttggaccgaatgttgcgtctcttggcttgttacaatatcctcacttgttcagttcgtactcaacaagatggaaaggttcagagactttatggtttggtactgttgctaa

SEQ ID NO: 30888 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30889 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30890 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30891 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30892 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcggttcgtactcaacaagatggaaagattcagagactttatggtttggctactgttgctaa

SEQ ID NO: 30893 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttggtcagttcgtactcaacaagatggaaaggttcagagactttatggtttggctactgttgctaa

SEQ ID NO: 30894 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaccgaatgttgcgtctcttggcttgttacaatatcctcacttgttcagttcgtactcaacaagatggaaagattcagagactttatggtttggctactgttgctaa

SEQ ID NO: 30895 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaccgaatgttgcgtctcttggcttgttacaatatcctcacttgttcagttcgtactcaacaagatggaaaggttcagagactttatggtttggctactgttgctaa

SEQ ID NO: 30896 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30897 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 30898 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30899 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30900 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30901 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 30902 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30903 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaagatgcaccagttatgttggaccgaatgttgcgtctcttggcttgttacaatatcctcacttgttcagttcgtactcgacaagatggaaaggttcagagactttatggtttggctactgttgctaa

SEQ ID NO: 30904 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaagatgcaccagttatgttggaccgaatgttgcgtctcttggcttgttacaatatcctcacttgttcagttcgtactcaacaagatggaaagtttcagagactttatggtttggctactgttgctaa

SEQ ID NO: 30905 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30906 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtttcttggcttgttacaatatcctcacttgttcagttcgtactcaacaagatggaaaggttcagagactttatggtttggctactgttgctaa

SEQ ID NO: 30907 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30908 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30909 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatggtgcgtctcttggcttgttacaatatcctcacttgttcagttcgtactcaacaagatggaaaggttcagagactttatggtttggctactgttgctaa

SEQ ID NO: 30910 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaactctgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 30911 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaactaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30912 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30913 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30914 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacgaccgaatgttgcgtctcttggcttgttacaatatcctcacttgttcagttcgtactcaacaagatggaaagattcagagactttacggtttggctactgttgctaa

SEQ ID NO: 30915 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacgaccgaatgttgcgtctcttggcttgttacaatatcctcacttgttcagttcgtactcaacaagatggaaaggttcagagactttatggtttggctactgttgctaa

SEQ ID NO: 30916 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30917 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30918 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30919 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30920 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30921 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30922 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30923 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 30924 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 30925 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30926 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30927 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttctgagactttatggtttggctactgttgctaa

SEQ ID NO: 30928 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgcgaa

SEQ ID NO: 30929 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30930 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30931 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcatggcttgttacaatatcctcacttgttcagttcgtactcaacaagatggaaaggttcagagactttatggtttggctactgttgctaa

SEQ ID NO: 30932 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30933 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30934 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaagattcagagactttatggtttggctactgttctaa

SEQ ID NO: 30935 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30936 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30937 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 30938 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30939 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaagattcagagactttatggtttggctactgttgtaa

SEQ ID NO: 30940 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30941 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30942 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagtgcgtactcaacaagatggaaaggttcagagactttatggtttggctactgttgctaa

SEQ ID NO: 30943 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcatactcaacaagatggaaaggttcagagactttatggtttggctactgttgctaa

SEQ ID NO: 30944 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30945 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30946 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30947 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30948 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaccagttatgttgggccgaatgttgcgtctcttggcttgttacgatatcctcacttgttcagttcgtactcaacaagatggaaaagttcagagactttatggtttggctactgttgctaa

SEQ ID NO: 30949 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 30950 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaagattcagagactttatggtttggctactgttgctaa

SEQ ID NO: 30951 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatttatgttggaccgaatgttgcgtctcttggcttgttacaatatcctcacttgttcagttcgtactcaacaagatggaaagattcagagactttatggtttggctactgttgctaa

SEQ ID NO: 30952 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaattatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30953 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaattatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30954 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30955 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 30956 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30957 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30958 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgttctcaacaagatggaaaggttcaaaggctttatggtttggctactgttgctaa

SEQ ID NO: 30959 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30960 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30961 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30962 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgtgtctcttggcttgttacaatatcctcacttgttctgttcgtactcaacaagatggaaagattcagagactttatggtttggctactgttgctaa

SEQ ID NO: 30963 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgtgcagttcgtactcaacaagatggaaaggttcagagactttatggtttgctactgttgctaa

SEQ ID NO: 30964 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttctgttcgtactcaacaagatggaaaggttcagagactttatggtgtggctactgttgctaa

SEQ ID NO: 30965 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30966 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaagttcggagactttatggtttggctactgttgctaa

SEQ ID NO: 30967 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30968 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaaggttcagagactttatggtttggctactgttgcta

SEQ ID NO: 30969 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30970 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 30971 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30972 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30973 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 30974 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactttatgttggaccgaatgttgcgtctcttggcttgttacaatatcctcacttgttcagttcgtactcaacaagatggaaaggttcagagactttatggtttggctactgttgctaa

SEQ ID NO: 30975 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactttatgttggaccgaatgttgcgtctcttggcttgttacaatatcctcacttgttcagttcgtactcaacaagatggaaaagttcagagactttatggtttggctatgttgctaa

SEQ ID NO: 30976 - DNA, 332 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacttgcgtctcttggcttgttacaatatcctcacttgttcagttcgtactcaacaagatggaaaggttcagagactttatggtttggctactgttgctaa

SEQ ID NO: 30977 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaaagttcagagactttatggtttggctactgttgctaa

SEQ ID NO: 30978 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttctgttcgtactcaacaagatggaaaggttcagagactttatggtttggctactgttgctaa

SEQ ID NO: 30979 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaaggttcagagactttatggtttggctactgttgctaa

SEQ ID NO: 30980 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30981 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30982 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30983 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaggttcagagactttatggtttggctactgttgctaa

SEQ ID NO: 30984 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaagttcagagactttatggtttggctactgttgctaa

SEQ ID NO: 30985 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttctgttcgtactcaacaagatggaaaggttcagagactttatggtttggctactgttgctaa

SEQ ID NO: 30986 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaggttcagagactttatggtttggctactattgctaa

SEQ ID NO: 30987 - DNA, 468 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactggtccagcggctgttgccaccattattgctggcgatggccaccacctgctggggggtcaagccgtgggcctggcacagcaccggcaacagccgctggaccgtctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30988 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactggcacagcaccggcaacagccgctggaccgtctccagcaccagttatgttggaccgaatgttgcgtctcttggcttgttacaatatcctcacttgttcagttcgtactcaacaagatggaaaggttcagagactttatggtttggctactgttgctaa

SEQ ID NO: 30989 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 30990 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 30991 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 30992 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaggttccgagactttatggtttggctactgttgctaa

SEQ ID NO: 30993 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcatactcaacaagatggaaaagttcagagactttatggtttggctactgttgctaa

SEQ ID NO: 30994 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctattgttgctaa

SEQ ID NO: 30995 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggctggttacaatatcctcacttgttcagttcgtactcaacaagattgaaaggttcagagactttatggtttggctactgttgctaa

SEQ ID NO: 30996 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagcctttatggtttggctactgttgctaa

SEQ ID NO: 30997 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactaacaagatggaaagattcagagactttatggtttggctactgttgctaa

SEQ ID NO: 30998 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 30999 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 31000 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactctatggtttggctactgttgctaa

SEQ ID NO: 31001 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaattttgcgtctcttggcttgttacaatatcctcacttgttcagttcttactcaacaagatggaaagattcagagactttatggtttggcgactgttgctaa

SEQ ID NO: 31002 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgcta

SEQ ID NO: 31003 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggttggctactgttgctaa

SEQ ID NO: 31004 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctac

SEQ ID NO: 31005 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaggatggaaaggttcagagactttatggtttggctactgttgctaa

SEQ ID NO: 31006 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgtgacaatatcctcacttgttcagttcgtactcaacaagatggaaaagttcagagactttatggtttggctactgttgctaa

SEQ ID NO: 31007 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcatgttacaatatcctcacttgttcagttcgtactcaacaagatggaaaggttcagagactttatggtttggctactgttgctaa

SEQ ID NO: 31008 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaattttgcgtctcttggcttgttacaatatcctcccttgttcagttcgtactcaacaagatggaaaggttcagagactttatggtttggctactgttgctaa

SEQ ID NO: 31009 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 31010 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 31011 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 31012 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgacggatggcctttttgcgtttctacaaactcttcctggctagcggtaccctgatgcaccagttatgttggaacgaatgttgcgtctcttggcttgttacaatatcctcacttgttcagttcgtactcaacaagatggaaaggttcagagactttatggtttggctactgttgctaa

SEQ ID NO: 31013 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgacgcaccagttatgttggaccgaatgttgcgtctcttggcttgttacaatatcctcacttgttcagttcgtactcaacaagatggaaagattcagagactttatggtttggctactgttgctaa

SEQ ID NO: 31014 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31015 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31016 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31017 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31018 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31019 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31020 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31021 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31022 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactcattgccaaatgtttgaacgatcgcgccctcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31023 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31024 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaagattcagagactttatggtttggctactgttgctaa

SEQ ID NO: 31025 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaagattcagagactttatggtttggctactgttgctaa

SEQ ID NO: 31026 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31027 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31028 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtcgcttggcttgttacaatatcctcacttgttcagttcgtactcaacaagatggaaagattcagagcctttatggtttggatactgttgctaa

SEQ ID NO: 31029 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31030 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactagcgtgaccgagttcaagttcctgttcgtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31031 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactagcgtgaccgagttcaagttcctgttcgtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31032 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactagccgtgggcctggcccaccaccggcaccagccgctggaccgtctccagcgcctgcttgccaccgccattgctggcgatggctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31033 - DNA, 472 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactagccccggagcaggtggtggccagcgccagcaatattggtggcaagcaggcgctggagacggtgcaggcgctgttgccggtgctgtgccaggcccacggcttgaccccccagcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31034 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31035 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31036 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31037 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31038 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaggttcagagactttatgggttggctactgttgctaa

SEQ ID NO: 31039 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31040 - DNA, 420 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaagccgtgggcctggcacagcaccggcaacagccgctggaccgtctccagcgcctgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31041 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaagcaccagttatgttggaccgaatgttgcgtctcttggcttgttacaatatcctcacttgttcagttcgtactcaacaagatggaaaagttcagagactttatggtttggctactgttgctaa

SEQ ID NO: 31042 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaagcaccagttatgttggaccgaatgttgcgtctcttggcttgttacaatatcctcacttgttcagttcgtactcaacaagatggaaaggttcagagactttatggtttggctactgttgctaa

SEQ ID NO: 31043 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaactccagcgcctgcttgccgccatcgtggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31044 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 31045 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31046 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31047 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaacctatgttggaccgaatgttgcgtctcttggcttgttacaatatcctcacttgttcagttcgtactcaacaagatggaaagattcagagactttatggtttggctactgttgctaa

SEQ ID NO: 31048 - DNA, 426 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccggcaacagcgcctgcaccgtctccagcgcctgcttgccaccaatattgctggcgatggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31049 - DNA, 428 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccgaacaggcttatgtccactgggttcgtgtggtggccatcgccagccacgatggcggcaagcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31050 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaacccgtgggcctggcacagcaccggcaacagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31051 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaacccgtgggcctggcacagcaccggcaacagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31052 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaacccgctggaccgtctccagcgcctgcttgccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31053 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31054 - DNA, 368 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccccctgatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 31055 - DNA, 369 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaacccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31056 - DNA, 396 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccatatttttttattttttttatttttcaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31057 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagttcgtactcaacaagatggaaaagttcagagactttatggtttggctactgttgctaa

SEQ ID NO: 31058 - DNA, 399 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccaccggcaacagcgcctgcaccgtctccagcgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31059 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccaccagttatgttggaccgaatgttgcgtctcttggcttgttacaatatcctcacttgttcagttcgtactcaacaagatggaaaagttcagagactttatggtttggctactgttgctaa

SEQ ID NO: 31060 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaccaccagttatgttggaccgaatgttgcgtctcttggcttgttacaatatcctcacttgttcagttcgtactcaacaagatggaaaggttcagagactttatggtttggctactgttgctaa

SEQ ID NO: 31061 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaacagataaaacgaaaggcccagtcttctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31062 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaacaccagttatgttggaccgaatgttgcgtctcttggcttgttacaatatcctcacttgttcagttcgtactcaacaagatggaaaggttcagagactttatggtttggctactgttgctaa

SEQ ID NO: 31063 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaacaccagttatgttggaccgaatgttgcgtctcttggcttgttacaatatcctcacttgttctgttcgtactcaacaagatggaaaggttcagagactttatggtttggctactgttgctaa

SEQ ID NO: 31064 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 31065 - DNA, 403 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaacgcaaaaaggccatccgtcaggatggccttctgcttagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31066 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31067 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacggatggcctttttgcgtttctacaaactcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31068 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 31069 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31070 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaggttcagagaccttatggtttggctactgttgctaa

SEQ ID NO: 31071 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31072 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccttatgcaccagttatgttggaccgaatgttgcgtctcttggcttgttacaatatcctctcttgttcagttcgtactcatcaatatggaaaggttcagagactttatggtttggctactgttgctaa

SEQ ID NO: 31073 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31074 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31075 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31076 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttgggccgaatgttgcgtctcttggcttgttacaatatcctcacttgttcagttcgtactcaacaagatggaaaagttcagagactttatggtttggctactgttgctaa

SEQ ID NO: 31077 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 31078 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcatggcttgttacaatatcctcacttgttcagttcgtactcaacaagatggaaaggttcagagactttatggtttggctactgttgctaa

SEQ ID NO: 31079 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggcgactgttgctaa

SEQ ID NO: 31080 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactttgctaa

SEQ ID NO: 31081 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggttactgttgctaa

SEQ ID NO: 31082 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 31083 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31084 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccaaatgttgcgtctcttggcttgttacaatatcctcacttgttcagttcgtactcaacaagatggaaaagttcagagactttatggtttggctactgttgctaa

SEQ ID NO: 31085 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttgcctactgttgctaa

SEQ ID NO: 31086 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31087 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31088 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31089 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaattttgcgtctcttggcttgttacaatatcctcacttgttcagttcgtactcaacaagatggaaaggttcagagcctttatggtttggctactgttgtaa

SEQ ID NO: 31090 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31091 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31092 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 31093 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 31094 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 31095 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31096 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31097 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccagttatgttggaccgaatgttgcgtctcttggcttgttacaatatcctcacttgttcagttcgtactcaacaagatggaaaggttcagagactttatggtttggctactgttgctaa

SEQ ID NO: 31098 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccaccagttatgttggaccgaatgttgcgtctcttggcttgttacaatatcctcacttgttcagttcgtactcaacaagatggaaagattcagagactttatggtttggctactgttgctaa

SEQ ID NO: 31099 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccaccagttatgttggaccgaatgttgcgtctcttggcttgttacaatatcctcacttgttcagttcgtactcaacaagatggaaaggttcagagactttatggtttggctactgttgctaa

SEQ ID NO: 31100 - DNA, 443 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccaacgagtggtggaagggctacccctccagcgtgaccgagttcaagttcctattcgtgtccggccacttcaagggcaactacctgatgcaccagttatgttggaccgaatgttgcgtctcttgacttgttacaatatcctcacttgttcagttcgtactcaacaagatggaaagattcagagactttatggtttggctactgttgctaa

SEQ ID NO: 31101 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31102 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31103 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31104 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 31105 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttgaaccgaatgttgcgtctcttggcttgttacaatatcctcacttgttcagttcgtactcaacaagatggaaaagttcagagactttatggtttggctactgttgctaa

SEQ ID NO: 31106 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacagttatgttggaccgaatgttgcgtctcttggcttgttacaatatcctcacttgttcagttcgtactcaacaagatggaaaagttcagagactttatggtttggctactgttgctaa

SEQ ID NO: 31107 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacagttatgttggaccgaatgttgcgtctcttggcttgttacaatatcctcacttgttcagttcgtactcaacaagatggaaaggttcagagactttatggtttggctactgttgctaa

SEQ ID NO: 31108 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaaggttcagagactttatggtttggctactgttgctaa

SEQ ID NO: 31109 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaagattcagagactttatggtttggctactgttgctaa

SEQ ID NO: 31110 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacaccagtcatgttggaccgaatgttgcgtctcttggcttgttacaatatcctcacttgttcagttcgtactcaacaagatggaaagattcagagactttatggtttggctactgttgctaa

SEQ ID NO: 31111 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 31112 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31113 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31114 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaagttcagagactttatggtttggctactgttgcta

SEQ ID NO: 31115 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31116 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaatgatgcaccagttatgttggaccgaatgttgcgtctcttggcttgtcacaatatcctcacttgttcagttcgtactcaacaagatggaaagattcagagactttatggtttggctactgttgctaa

SEQ ID NO: 31117 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31118 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31119 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31120 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaaccagttatgttggaccgaatgttgcgtctcttggcttgttacaatatcctcacttgttcagttcgtactcaacaagatggaaaggttcagagactttatggtttggctactgttgctaa

SEQ ID NO: 31121 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaaagcgacttttgaacgcgcaataatggtttctgacgtatgtgcttagctcattaaactccagaaacccgcggctgagtggctccttcaacgttgcggttctgtcaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31122 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttcagttcgtactcaacaagatggaaaggttcagagactttatggtttggctactgttgctaa

SEQ ID NO: 31123 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttctgttcgtactcaacaagatggaaaggttcagagactttatggtttggctactgttgctaa

SEQ ID NO: 31124 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttcagttcgtactcaacaagatggaaagattcagagactttatggtttggctactgttgctaa

SEQ ID NO: 31125 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31126 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31127 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaagattcagagactttatggtttggctactgttgctaa

SEQ ID NO: 31128 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagcccctgatgcaccagttatgttgtaccgaattttgcgtctcttggcttgttacaatatcctcacttgttcagttcgtactcaacaagatggaaaggttcagagactttatggtttggctactgttgctaa

SEQ ID NO: 31129 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31130 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagatgcaccagttatgttggaccgaatgttgcgtctcttggcttgttacaatatcctcacttgttcagttcgtactcaacaagatggaaagattcagagactttatggtttggctactgttgctaa

SEQ ID NO: 31131 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagataccaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31132 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagaccgaatgttgcgtctcttggcttgttacaatatcctcacttgttcagttcgtactcaacaagatggaaagattcagagactttatggtttggctactgttgctaa

SEQ ID NO: 31133 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcacctgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 31134 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcacctgatgcaccagttatgttggaccgaatgttgcgtctcttggattgttacaatatcctcacttgttcagttcgtactcaacaagatggaaaggttcagagactttatggtttggcaactgtagctaa

SEQ ID NO: 31135 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31136 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31137 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcacctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 31138 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaaagttcagagactttatggtttggctactgttgctaa

SEQ ID NO: 31139 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaaggttcagagactttatggtttggctactgttgctaa

SEQ ID NO: 31140 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcaactcccaacgtgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31141 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcaactcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31142 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcaactaccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31143 - DNA, 270 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcaacaagatggaaaagttcagagactttatggtttggctactgttgctaa

SEQ ID NO: 31144 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttcacagctcccaacaccccagcaggtggtggccatcgccagcaatggcggtggcaagcaggcgctggagacggtccagcggctgttgccggtgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31145 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcgtctcagctaccaacaactgatgcaccagtcatgttggaccgaatgttgcgactcttggcatgttacaatatcctcacttcttctgttcgtactcaacaagatggaaaggttcagagactttatggtttggctactgttgataa

SEQ ID NO: 31146 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31147 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattacttctcagctaccaacaacttgcaccagttatgttggaccgaatgttgcgtctcttggcttgttacaatatcctcacttgttcagttcgtactcaacaagatggaaaggttcagagactttatggtttggctactgttgctaa

SEQ ID NO: 31148 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31149 - DNA, 338 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31150 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31151 - DNA, 337 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 31152 - DNA, 331 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaaccagttatgttggaccgaatgttgcgtctcttggcttgttacaatatcctcacttgttcagttcgtactcaacaagatggaaaggttcagagactttatggtttggctactgttgctaa

SEQ ID NO: 31153 - DNA, 331 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaaccagttatgttggaccgaatgttgcgtctcttggcttgttacaatatcctcacttgttcagttcgtactcaacaagatggaaagattcagagactttatggtttggctactgttgctaa

SEQ ID NO: 31154 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctactgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31155 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctactgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31156 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcaccagtcatgttggaccgaatgttgcgtctcttggcttgttacaatatcctcacttgttctgttcgtactcaacaagatggaaaggttcagagactttatggtttggctactgttgctaa

SEQ ID NO: 31157 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcaccagtcatgttggaccgaatgttgcgtctcttggcttgttacaatatcctcacttgttcagttcgtactcaacaagatggaaaggttcagagactttatggtttggctactgttgctaa

SEQ ID NO: 31158 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgcgcaaatttcacctattgaaattgcttctcagctcccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31159 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgcccaaatttcacctattgaaattgcttctcagctcccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31160 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgcccaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31161 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 31162 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaaagttcagagactttatggtttggctactgttgctaa

SEQ ID NO: 31163 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgcacaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31164 - DNA, 314 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgatgcaccagttatgttggaccgaatgttgcgtctcttggcttgttacaatatcctcacttgttcagttcgtactcaacaagatggaaaagttcagagactttatggtttggctactgttctaa

SEQ ID NO: 31165 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31166 - DNA, 277 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgatcaaatttcacctattgaaattgcttctcagctcccaacaagatggaaagattcagagactttatggtttggctactgttgctaa

SEQ ID NO: 31167 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgatcaaatttcacctattgaaattgcttctcagctaccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 31168 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgatcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31169 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtactcaaatttcacctgttcaaattgcttctcagcttccaacactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 31170 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtactcaaatttcacctgttcaaattgcttctcagcttccaacaactctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31171 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtactcaaatttcacctattgaaattgcttctcagctcccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31172 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggagctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31173 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctgatgctcaaatttcacctattgaaattgcttctcagctaccaacaccagttatgttggaccgaatgttgcgtctcttggcatgttacaatatcctcacttgttcagttcgtactcaacaagatggaaaagttcagagactgtatggtttggctactgttgctaa

SEQ ID NO: 31174 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31175 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctgatgcaccagttatgttggaccgaatgttgcgtctcttggcttgttacaatatcctcacttgttcagttcgtactcaacaagatggaaaagttcagagcctttatggtttggctactgttgccaa

SEQ ID NO: 31176 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31177 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctcgtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31178 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctcgtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31179 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctagtgctcaaatttcacctattgaaattgcttctcagctaccaacaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31180 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggaccgaatgttgcgtctcttggcttgttacaatatcctcacttgttctgttcgtactcaacaagatggaaaggttcagagactttatggtttggctactgttgctaa

SEQ ID NO: 31181 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggaccgaatgttgcgtctcttggcttgttacaatatcctcacttgttcagttcgtactcaacaagatggaaaggttcagagactttatggtttggctactgttgctaa

SEQ ID NO: 31182 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggaccgaatgttgcgtctcttggcttgttacaatatcctcacttgttcagttcgtactcaacaagatggaaagattcagagactttatggtttggctactgttgctaa

SEQ ID NO: 31183 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacatggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31184 - DNA, 343 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggaactggtgctcaaatttcacctattgaaattgcttctcagctcccaacaactggaccgaatgttgcgtctcttggcttgttacaatatcctcacttgttcagttcgtactcaacaagatggaaagattcagagcctttatggtttggctactgttgctaa

SEQ ID NO: 31185 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggaactggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31186 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31187 - DNA, 310 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctgcctgatgcaccagttatgttggaccgaatgttgcgtctcttggcttgttacaatatcctcacttgttcagttcgtactcaacaagatggaaagattcagagactttatggttcggctactgttgctaa

SEQ ID NO: 31188 - DNA, 410 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctgcaccgtctccagcgcctgcttgccaccaatattgctggcgatggccaccacctgctccggggtcaagccgtgggcctggcacagcaccggcaacagccgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31189 - DNA, 410 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctgcaccgtctccagcgcctgcttgccaccaatattgctggcgatggccaccacctgctccggggtcaagccgtgggcctggcacagcaccggcaacagccgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31190 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctgagttatgttggaccgaatgttgcgtctcttggcttgttacaatatcctcacttgttcagttcgtactcaactagatggaaaggttcagagactttatggtttggctactgttgctaa

SEQ ID NO: 31191 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctgagttatgttggaccgaatgttgcgtctcttggcttgttacaatatcctcacttgttcagttcgtactcaacaagatggaaaggttcagagactttatggtttggctactgttgctaa

SEQ ID NO: 31192 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctcgacatggtgctcaaatttcacctattgaaattgcttctcatatcccaacagatgcaccagttatgttgaaccgaatatttcgtctcttcacttgttacaatatcctcacttcttcacttcctactcaacaatattcaaaagttcagagactttatggtttcactactcttcctaa

SEQ ID NO: 31193 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgccaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31194 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgccaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31195 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgccaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31196 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31197 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcactgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31198 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcaatgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31199 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttacaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31200 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctcagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31201 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctctcagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31202 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcctagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31203 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcctagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31204 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctacaagatggaaaggttcagagactttatggtttggctactgttgctaa

SEQ ID NO: 31205 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctacaagatggaaagattcagagactttatggtttggctactgttgctaa

SEQ ID NO: 31206 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgacctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31207 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaactcgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31208 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacatgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31209 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31210 - DNA, 269 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctctgcaccagttatgttggaccgaatgttgcgtctcttggcttgttacaatatcctcacttgttcagttcgtactcaacaagatggaaaggttcagagactttatggtttggctactgttgctaa

SEQ ID NO: 31211 - DNA, 269 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctctgcaccagttatgttggaccgaatgttgcgtctcttggcttgttacaatatcctcacttgttcagttcgtactcaacaagatggaaagattcagagactttatggtttggctactgttgctaa

SEQ ID NO: 31212 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctctcgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31213 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctctcgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31214 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctctcgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31215 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctctatgttggaccgaatgttgcgtctcttggcttgttacaatatcctcacttgttcagttcgtactcaacaagatggaaaggttcagagactttatggtttggctactgttgctaa

SEQ ID NO: 31216 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcctgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31217 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctattgaacttgatctcttagaaatcattgctaaagctggacctggtgctcaaatttaacctattgaaattgcttctcagctaccaacgactgatgcaccagttatgttggaccgaatgttgcgtctcttggcttgttacaatatccacacttgttcagttcgtactcaacaagatggaaaggttcagagactttatggtttggctactgttgctaa

SEQ ID NO: 31218 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttgaaatcagctcttgaacttgatctcttagaaatcattgctaaagctggacctggtgctcaaatttcacctgttcaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31219 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31220 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 31221 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttgaaatcagctcttgaacttgatctcttagaaatcattgctaaagctggacctggtgctcaaatttcacctattgaaattgcttctcagctaccaacaactaaccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31222 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31223 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31224 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaaggttcagagcctttatggtttggctactgttgctaa

SEQ ID NO: 31225 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcgaaatcagctcttgaacttgatctcttagaaatcattgctaaagctggacctggtgatcaaatttcacatattgaaattgcttctcagctcccaacaactgatacaccagttctgtttgtccgaattttacgtctcttggcttgttacaatatcctcacttgttcagttcgtactcaacaagatgaaaaggttcagagcctttatggtttggctcctgtttctaa

SEQ ID NO: 31226 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttcaaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatggaaaggttcagagactttatggtttggctactgttgctaa

SEQ ID NO: 31227 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttagaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31228 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttaaaatcagctcttgaacttgatctcttagaaatcattgctaaagctggacctggtgctcaaatttcacctgttcaaattgcttctcagcttccaacacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31229 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 31230 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattgtgaaatcagctcttgaacttgatctcttggcttgttacaatatcctcacttgttcagttcgtactcaacaagatggaaaggttcagagactttatggtttggctactgttgctaa

SEQ ID NO: 31231 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattgtgaaatcagctcttgaacttgatctcttagaaatcattgctaaagctggacctggtgctcaaatttcacctattgaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31232 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattgtgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31233 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattgtaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 31234 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31235 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31236 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcagctcttgaacttgatctcttagaaatcattgctaaagctggacctggtgctcaaatttcacctattgaaattgcttctcagctaccaacaatgatgcaccagttatgttggaccgaatgttgcgtctcttgacttgttacaatatcctcacttgttcagttcgtactcaacaagatggaaagattcagagactttatggtttggctactgttgctaa

SEQ ID NO: 31237 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttggctactgttgcttaa

SEQ ID NO: 31238 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattctgaaatcagctcttgaacttgatctcttagaaatcattgctaaagctggacctggcgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31239 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgattatgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31240 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatgttgaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31241 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatgttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31242 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgatcttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31243 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgagtttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31244 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgactttgaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31245 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccatgactttgaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31246 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccataattttgaaatgagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31247 - DNA, 317 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccataattttgaaatcagctcttgaacttgatctcttagaaatcattgctaaagctggacctggtgtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31248 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccataattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31249 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccacgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31250 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccacgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31251 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcccacgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31252 - DNA, 249 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttggcttgttacaatatcctcacttgttcagttcgtactcaacaagatggaaagattcagagactttatggtttggctactgttgctaa

SEQ ID NO: 31253 - DNA, 398 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaaatcattgctaaagctggacctggtgctcaaatttcacctattgaaattgcttctcagctcccaacaactaaccggtgctgtgccaggcccacggcttgaccccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31254 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaaagttcagagactttatggtttggctactgttgctaa

SEQ ID NO: 31255 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaacttgatctcttagaaatcattgctaaagctggacctggtgctcaaatttcacctattgaaattgcttctcagctaccaacaaagttatctcgccctgatccggcgttggcccctgatgcaccagttatgttggaccgaatgttgcatctcttggcttgttacaatatcctcacttgttcagttcgtactcaacaagatggaaaagttcagagactttatggtttggctactgttgctaa

SEQ ID NO: 31256 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttccaatgattttgaaatcagctcttgaaattgatctcttaaaaataattgctaaagctggacctggtgctcaaatttcacctattgaaattgcttctcagctaccaaccctgatgcaccagttattttggaacgaatggtgagtctcttggcttgttacaatatccacacttgttcagttagtactcaacaagatggaaaggttcagagactttatggtttggctactgttgctaa

SEQ ID NO: 31257 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31258 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttgaaatcagctcttgaacttgatctcttagaaatcattgctaaagctggacctggtgctcaaatttcacctattgaaattgcttctcagctaccaacaatgcaccagttatgttggaccgaatgtggcgtctcttggcttgtttcaatatcctcgcttgttcagttcgtactcaacaagatggaaaagttcagagcctttatggtttggcgactgttgctaa

SEQ ID NO: 31259 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31260 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31261 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31262 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttgaaatcagctcttgaacttgatctcttagaaatcattgctaaagctggacctgatgctcaaatttcacctattgaaattgcttctcatctaccaacaatgatgcaccagttatgttttacctaatgttgcgtctcttttctttttacaatatcctcacttgttcatttcttactcaacaagatttaaagtttcacagactttatggtttgcctacttttgctaa

SEQ ID NO: 31263 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcacatgattttgaaatcagctcttgaacttgatctcttagaaatcattgctaaagctagacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31264 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttcaaatgattttgaaatcagatgttgaacttgatatattagaaatcattgctaaaactgaacctggtgctcaaatttcacctattgaaattgcttctcatctaccaacaactgatgcaccagttatgttgtacccaatattgcatctctttactttttacaatatcctcacttattcatttcttactcaacaagatttaaatgttcatatactttattattttcctactttttctaa

SEQ ID NO: 31265 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttaccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgatcagttcgtactcaacaagatggaaagattcagagactttatggtttggctactgttgctaa

SEQ ID NO: 31266 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcttaccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31267 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttctccccatgattttgaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31268 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttctccccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31269 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttctccccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31270 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttctccccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31271 - DNA, 315 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttctccccatgattttgaaatcagctcttgaacttgatctcttagaaatcattgctaaagctggacctggtgatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 31272 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttctccccatgattttaaaatcagctcttgaacttgatctcttagaaatcattgctaaagctggacctggtgctcaaatttcacctattgaaattgcttctcagctaccaacaactaaatgcaccagttatgttggaccgaatgttgcgtctcttggcttgttacaatatcctcacttgttcagttcgtactcaacaagacggaaaggttcagagactttatggtttggctactgttgctaa

SEQ ID NO: 31273 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttctcccatgattttaaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31274 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcgtcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagaggctttatggtttggctactgttgctaa

SEQ ID NO: 31275 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcctcccatgattttgaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31276 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcctcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31277 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcctcccatgattttgaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31278 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcatcccatgattttgaaatcagctcttgaacttgatctcttagaaatcattgctaaagctggacctggtgctcaaatttcacctgttcaaattgcttctcagcttccaacaactaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 31279 - DNA, 389 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttcatcccatgattttgaaatcagctcttgaacttgatctcttagaaatcattgctaaagctggacctggtgctcaaatttaacctattgaaattgcttctcagctaccaacaactagcgtgaccgagttcaagttcctgttcgtgctgcaccagttatgttgtaccgaattttgcgtctcttggcttgttacaatatcctcacttgttcagttcgtactcaacaagatggaaagattcagagactttatggtttggctactgttgctaa

SEQ ID NO: 31280 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagttattcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31281 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagtccttcccatgattttgaaatcagctcttgaacttgatctcttagaaatcattgctaaagctggacctggtgctcaaatttcacctattgaaattgcttctcagctaccaacaaccaaccagttatgttggaccgaatgttgcgtctcttggcttgttacaatattctcacttgttcagttcgtactcaacaagatggaaaagttcagagactttatggtttggctactgttgctaa

SEQ ID NO: 31282 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagtccttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31283 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcaggtcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31284 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagctcttcccatgattttgaaatcagctcttgaacttgatctcttagaaatcattgctaaagctggacctggtgctcaaatttcacctattgaaattgcttctcagcttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31285 - DNA, 288 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagctcttcccatgattttgaaatcagctcttgaacttgatctcttagaaatcattgctaaagctggacctggtgctcaaatttcacctattgaaattgcttctcagctcccaacaacgtactcaacacgatggaaggttcagagactttatggtttggctactgttgctaa

SEQ ID NO: 31286 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagctcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31287 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagctcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31288 - DNA, 402 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagctcttcccatgattttgaaatcagctcttgaacttgatctcttagaaatcattgctaaagctggacctggtgctcaaatttcacctattgaaattgcttctcagctaccaacaactgaagaagatcgcttggcctcgcgcgcagatcagttggaagaatttgtccactacgtgaaaggcgagatcaccaatctcttggcttgttacaatatcctcacttgttcagttcgtactcaacaagatggaaaggttcagagactttatggtttggctactgttgctaa

SEQ ID NO: 31289 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagctcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31290 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcagatcttcccatgattttgaaatcagctcttgaacttgatctcttagaaatcattgctaaagctggacctggtgctcaaatttcacctattgaaattgcttctcagctaccaacaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31291 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttcaattcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31292 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcttaagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31293 - DNA, 350 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgctccagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31294 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgctccagttcttcccatgattttaaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31295 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgctcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31296 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgctcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31297 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgctacagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgtgacaatatcctcacttggtcagttcgtactcaacaagatggaaaggttcagagactttatggtttggctactgttgctaa

SEQ ID NO: 31298 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgctacagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31299 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcgtcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31300 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcgtcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31301 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcgtcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31302 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcctcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31303 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcctcagttcttcccatgattttgaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagttcgtactcaacaagatggaaaagttcagagactttatggtttggctactgttgctaa

SEQ ID NO: 31304 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcctcagttcttcccatgattttgaaatcagctcttgaacttcatctcttagaaatcattgctaaagctggacctggtgctcaaatttcacctattgaaattgcttctcagctaccaacaacctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31305 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcctcagttcttcccatgattttaaaatcagctcttgaacttgatctcttagaaatcattgctaaagctggacctggtgctcaaatttcacctattgaaattgcttctcagctaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31306 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcatcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcagcaagatggaaaggttcagagactttatggtttggctactgttgctaa

SEQ ID NO: 31307 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgcatcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31308 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtgattcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31309 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtacttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31310 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtacttcagttcttcccatgattttgaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 31311 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtacttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31312 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtacttcagttcttcccatgattttgaaatcagctcttgaacttgatctcttagaaatcattgctaaagctggacctggtgctcaaatttcacctattgaaattgcttctcagctaccaacaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31313 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtacttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31314 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagtacttcagttcttccaatgattttgaaatcagctcttgaacttgatctcttagaaatcattgctaaagctggacctgttgctcaaatttctcctattgaaattgcttctcagctaccaacaactgatgcaccagttatattggaccgaattttgcgtcacttggcttgttacaatatccacactagttcaggtcctactaaacaagatggaaagattcagagacattatggtttggctactgttcataa

SEQ ID NO: 31315 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcgcctattgaaattgcttctcagctaccaacaactgatgcaccagttatgttggaccgaatgttgcgtctcttggcttgttacaatatcctcacttgttcacttcgtactcaacaagatggaaaggttcagagactttatggtttggctactgttgctaa

SEQ ID NO: 31316 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31317 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31318 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31319 - DNA, 394 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctcccaacaactaaggcgctggagacggtccagcggctgttgccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31320 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31321 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31322 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31323 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31324 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31325 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31326 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaactgcaccagttatgttggaccgaatgttgcgtctcttgacttgttacaatatcctcacttgttcagttcgtactcaacaagatggaaaagttcagagactttatggtttggctactgttgctaa

SEQ ID NO: 31327 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31328 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31329 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31330 - DNA, 466 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaactccgtctccagcgcctgcttgccgccatcgtggctggcgatggccaccacctgctccggggtcaggccgtgggcctggcacagcaccggcaacagccgctggaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31331 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31332 - DNA, 414 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaactaaccccggagcaggtggtggccagcgacagccgcgatggcggcaagcaggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31333 - DNA, 440 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaactaaccagaccaggaacaagcacatcaaccccaacgagtggtggaaggtgtgcccctccagcgtgaccgagttcaagttcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31334 - DNA, 440 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaactaaccagaccaggaacaagcacatcaaccccaacgagtggtggaaggtgtacccctccagcgtgaccgagttcaagttcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31335 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31336 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31337 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31338 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31339 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31340 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcaccaattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31341 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttaaaatcagctcttgaacttgatctcttagaaatcattgctaaagctggacctggtgctcaaatttcgcctattgaaattgcttctcagctcccaacagttatgttggaccgaatgttgcgtctcttggcttgttacaatatcctcacttgttcagttcgtactcaacaagatggaaaggttcagagactttatggtttggctactgttgctaa

SEQ ID NO: 31342 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgataa

SEQ ID NO: 31343 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31344 - DNA, 430 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttaaaatcagctcttgaacttgatctcttagaaatcattgctaaagctggacctggtgctcaaatttcacctattgaaattgcttctcagctaccaacaactacccacggcttgaccccggagcaggtggtggccatcgccaggcacgatggcggcaagcaggcgctggactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31345 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttaaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31346 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagttcttcccatgattttaaaatcagctcgtgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31347 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcttcagctcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctctcttgttctgttcgtactcaacaagatggaaaggttcagagactttatggtttggctactgttgctaa

SEQ ID NO: 31348 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagggcgtcagttcttcccatgattttgaaatcagctcttgaacttgatctcttagaaatcattgctaaagctgaacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31349 - DNA, 348 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagcgcttcagttcttcccatgattttgaaatcagctcttgaacttgatctcttagaaatcattgctaaagctggacctggtgctcaaatttcacctattgaaattgcttctcagctcccaacagttatgttggaccgaatgttgcgtctcttggcttgttacaatatcctcacttgttcagttcgtactcaacaagatggaaaggttcagagactttatggtttggctactgttgctaa

SEQ ID NO: 31350 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagcgcttcagttcttcccatgattttgaaatcagctcttgaacttgatctcttagaaatcattgctaaagctggacctggtgctcaaatttcacctattgaaattgcttctcagctaccaacgcaccagttatgttggaccgaatgttgcgtctcttggcttgttacaatatcctcacttgttcagttcgtactcaacaagatggaaagattcagagactttatggtttggctactgttgctaa

SEQ ID NO: 31351 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagcgcttcagttcttcccatgattttaaaatcagctcttgaacttgatctcttagaaatcattgctaaagctggacctggtgctcaaatttcacctattgaaattgcttgcaccagttatgttggaccgaatgttgcgtctcttggcttgttacaatatcctcacttgttcagttcgtactcaacaagatggaaaggttcagagactttatggtttggctactgttgctaa

SEQ ID NO: 31352 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaagagcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccttatgttgcgtctcttggcttgttacaatatcctcacttgttcagttcgttctcaactagatggaaagtttcagagactttagggtctggctactgttgctaa

SEQ ID NO: 31353 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaactgcttcagttcttcccatgattttaaaatcagctcttgaacttgatctcttagaaatcattgctaaagctggacctggtgctcaaatttcacctattgaaattgcttctcagctcccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31354 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaaatgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31355 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagcaaatgcttcagttcttcccatgattttgaaatcagctcttgaacttgatctcttagaaatcattgctaaagctggacctggtgctcaaatttcacctattgaaattgcttctcagctaccaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31356 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactagaaagtgcttcagttcttcccatgattttaaaatcagctattgaacttgatctctttgaaatcattgctaaagcaggacctggtgctcaaatttcacctgttcaaattgcttctcagcttccaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31357 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatcattgctaaagctggacctggtgcttaaatttcacctattgaaattgcttctcagctaccagttatgttggaccgaatgttgcgtctcttggcttgttacaatatcctcactttttcagttcgtactcaacaagatggaaaggttcagagactttatggtttggctactgttgctaa

SEQ ID NO: 31358 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31359 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31360 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttcctaa

SEQ ID NO: 31361 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccctatgcaccagttatgttggaccgaatgttgcgtctcttggcttgttacaatatcctcacttgttcagttcgtactcaacaagatggaaagattcagagactttatggtttggctactgttgctaa

SEQ ID NO: 31362 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31363 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31364 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31365 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaagattcagagactttatggtttggctactgttgctaa

SEQ ID NO: 31366 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacaactgcaccagttatgttggaccgaatgttgcgtctcttggcttgttacaatatcctcccttgttcagttcgtactcaacaagatggaaagattcagagactttatggtttggctactgttgctaa

SEQ ID NO: 31367 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31368 - DNA, 351 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagcctgatgcaacagttaagttggaccgaatgttgcgtatcttggcttgttacaatatcctcacttgttcagttcgtactcaacaagatggaaaagttcagagactttatggtttggctactgttgctaa

SEQ ID NO: 31369 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttgaaatcagctcttgaacttgatctcttagaaatcattgctaaagctggacctggtgctcaaatttcacctattgaaattgcttctcagcccctgatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 31370 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaactaacaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31371 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaaccagcaagtgcttcagttcttcccatgattttgaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaaggttcagagactttatggtttggctactgttgctaa

SEQ ID NO: 31372 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaaccagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31373 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaaccagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31374 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaaccagcaagtgcttcagttcttcccatgattttgaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaaggttcagagactttatggtttggctactgttgctat

SEQ ID NO: 31375 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaaccagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactgttgctaa

SEQ ID NO: 31376 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaacaagcaagtgcttcagttcttcccatgattttgaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 31377 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaaatagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31378 - DNA, 387 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaaatagcaagtgcttcagttcttcccatgattttgaaatcagctcttgaacttgatctcttagaaatcattgctaaagctggacctggtgctcaaatttcacctattgaaattgcttctcagctcccaacaactcttcctggctagcggtacgcgtaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31379 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgcaaatagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggctggttacaatatcctcacttgttcagttcgtactcaaccagatggaaagattcagagactttatggtttggctactgttcctaa

SEQ ID NO: 31380 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31381 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctca

SEQ ID NO: 31382 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31383 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgaaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggcttggctactgttgctaa

SEQ ID NO: 31384 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgaaattagcaagtgcttcagttcttccaatgattttaaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31385 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgaaattagcaagggcttaagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31386 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgaaactagcaagtgcttcagttcttcccatgattttgaaatcagctcttgaacttgatctcttagaaatcattgctacagctggacctggtgctcaaatttcacctattgaaattgcttctcagctcccaacaactgatgcaccagttatgttggaacgaatgttgcgtctcttggcttgttacaatatcctcacttgttcagttcgtactcaacaagatggaaagattcagagactttatggtttggctactgttgctaa

SEQ ID NO: 31387 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgaaactagcaagtgcttcagttcttcccatgattttgaaatcagctcttgaacttgatctcttagaaatcattgctaaagctggacctggtgctcaaatttcacctattgaaattgcttctcagttcccaacaactactgatgcaccagttatgttggaccgaatgttgcctctcttttcttgttacaatatcctcacttgttcagttcgtactcaacaagattgaaatattcagagactttatcgtttggctactgttgctaa

SEQ ID NO: 31388 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgaaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggatcgaatgttgcgtctcttggcttgttacaatatcctcacttgttcagttcgtactcaacaagatggaaagattcagagactttatggtttgggctactgttgctaa

SEQ ID NO: 31389 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgaaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 31390 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgaaactagcaagtgcttcagttcttcccatgattttgaaatcagctcttgaacttgatctcttagaaatcattgctaaagctggacctggtgctcaaatttcacctattgaaattgcttctcagctaccaacaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 31391 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatgaaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31392 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatccaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaagattcagagactttatggtttggctcctgttgctaa

SEQ ID NO: 31393 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatccaattagcaagtgcttcagttcttcccatgattttaaaatcagctcttgaacttgatctcttagaaatcattgctaaagctggaccaggtgctcaaatttcacctattgaaattgcttctcagctcccaacaacatgttggaccgaatgttgcgtctcttggcttgttacaatatcctcacttgttcagttcgtactcaacaagatggaaaggttcagagactttatggtttggctactgttgctaa

SEQ ID NO: 31394 - DNA, 410 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatccaactagcaagtgcttcagttcttcccatgattttgaaatcagctcttgaacttgatctcttagaaatcattgctaaagctggacctggtgctcaaatttcacctagtgaaattgcttctcagctcccaacaacgaccaggaacaagcacatcaaccccaacgagtggtggaaggtgtaccccctgatgcaccagttacgttggaccgaatgttgcgtctcttggcttgttacaatatcctcacttgttcagttcgtactcaacaagatggaaaggttcagagactttatggtttggctactgttgctaa

SEQ ID NO: 31395 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatccaactagcaagggcttcagttcttcccatgattttgaaatcagctcttgaacttgatctcttagaaatcattgctaaagctggacctggtgctcaaatttcacctattgaaattgattctcagctaccaacaacgcaccagttatgttggaccgaatgttgcgtctcttggcttgttacaatatcctcacttgttcagttcgtactcaacaagatggaaaggttaagagcctttatggtttggctactgttgataa

SEQ ID NO: 31396 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatccaactagcaagggcttcagttcttcccatgattttaaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31397 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttgaaatcagctcttgaacttgatctcttagaaatcattgctaaagctggacctggtgctcaaatttcacctgttcaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31398 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31399 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31400 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttgaaatcagctcttgaacttgatctcttagaaatcattgctaaagctggaactggtgctcaaatttcacctattgaaattgcttctcagctaccaacatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31401 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctcccaacacgcaccagttatgttggaccgaatgttgcgtctcttggcttgttacaatatcctcacttgttcagttcgtactcaacaagatggaaagattcagagactttatggtttggctactgttgctaa

SEQ ID NO: 31402 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctcccaacaagcaatggcggcggcaggccggcgctggagactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31403 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31404 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31405 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31406 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31407 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31408 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31409 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31410 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31411 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctaccaacaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31412 - DNA, 207 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctacaagatggaaagattcagagactttatggtttggctactgttgctaa

SEQ ID NO: 31413 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctgtacctggtgctcaaatttcacctattgacattgcttctcatatcccaactgatgcaccagttatgttggaccgaatgttgcgtctcttggcttgttacactatcctcccttgttcagtccgtactcaacaagatggaaagattcagagactttatggtttggctactgttgctaa

SEQ ID NO: 31414 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgacttgttacaatatcctcacttgttcagttcgtactcaacaagatggaaaggttcagagactttatggtttggctactgttgctaa

SEQ ID NO: 31415 - DNA, 334 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31416 - DNA, 336 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaatttcaccagttatgttggaccgaatgttgcgtctcttggcttgttacaatatcctcacttgttcagttcgtactcaacaagatggaaaggttcagagactttatggtttggctactgttgctaa

SEQ ID NO: 31417 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31418 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31419 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31420 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31421 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31422 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31423 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31424 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagtcatgttggaccgaatgttgcgtctcttggcttgttacaatatcctcacttgctctgttcgtactcaacaagatggaaaggttcagagactttatggtttggctactgttgctaa

SEQ ID NO: 31425 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctaccaacaactaaccagttatgttggaccgaatgttgcgtctcttggcttgttacaatatcctcacttgttcagttcgtactcaacaagatggaaaggttcagagactttatggtttggctactgttgctaa

SEQ ID NO: 31426 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31427 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggaccgaatgttgcgtctcttggcttgttacaatatcctcacttgttcagttcgtactcaacaagatggaaaggttcagagactttatggtttggctactgttgctaa

SEQ ID NO: 31428 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccaggcaattagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31429 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccaggcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31430 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccaggcaattagcaagtgcttcagttcttcccatgattttaaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31431 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31432 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31433 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgtgggtga

SEQ ID NO: 31434 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31435 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31436 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaatcattgctaaagctggacctggtactcaaatttcacctattgaaattgcttctcagctcccacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31437 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcttgaacttgatctcttagaaatcattgctaaagctggacctggtactcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31438 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccacgcaattagcaagtgcttcagttcttcccatgattttaaaatcagctcgtgaacttgatctcttagaaatcattgctaaagctggacctggtgctcaaatttcacctattgaaattgcttctcagctcccaacaagcaatggcggcggcaggccggcgctggagactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31439 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagcttccaacaactaggcgctggagacggtgcaggcgctgttgccggtgctgtgccaggcccacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31440 - DNA, 435 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagctcccaacaactaacaacaacaaaccaacccttagttgcacacccttgtgtttttctttgtttgttgtttgttttattttcttagtccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31441 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31442 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31443 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31444 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccacgcaactagcaagtgcttcagttcttcccatgattttgaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcgcttgttcagttcgtactcaacaagatggaaaggttcagagactttatggtttggctactgttgctaa

SEQ ID NO: 31445 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgccaagcaactagcaagtgcttcagttcttcccatgattttgaaatcagctcttgaacttgatatcttagaaatcattgctaaagctggacctgttgctcaaatttcacctattgaaattgcttctcagctaccaacaactgatgcaccagttatgttggaccgaatgttgcgtctcttggcttgttacaatatcctcactttttcagttcgtacccaacaagatggaaaggttcagagactttatggtttggctactgttgctaa

SEQ ID NO: 31446 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgcatggcaataaccaagggcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31447 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgcatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31448 - DNA, 289 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgcaatgcaattagcaagtgcttcagttcttcccatgattttaaaatcagctcttgaacttgatctcttagaaatcattgctaaagttggaccgaatgttgcgtctcttggcttgttacaatatcctcacttgttcagttcgtactcaacaagatggaaaggttcagagactttatggtttggctactgttgctaa

SEQ ID NO: 31449 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgcaatgcaattagcaagtgcttcagttcttcccatgattttaaaatcagctcttgaacttgatctcttagaaatcattgctaaagctgtacctggtgctcaaatttcacctattgaaattgcttctcagctaccaacaactatgcaccagttatgttggaccgaatgttgcgtctcttgtcttgttacaatatcctcacttgttcagttcgtactcaacaagatggaaaatttcagagactttatggtttggctactgttgctaa

SEQ ID NO: 31450 - DNA, 390 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgcaatgcaattagcaagtgcttcagttcttcccatgattttaaaatcagctcttgaacttgatctcttagaaatcattgctaaagctggacctggtgctcaaatttcacctattgaaattgcttctcagctcccaacaagcaatggcggcggcaggccggcgctggagagtgatgcaccagttatgttggaccgaatgttgcgtctcttggcttgttacaatatcctcacttgttcagttcgtactcaacaagatggaaagattcagagactttatggtttggctactgtagctaa

SEQ ID NO: 31451 - DNA, 399 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgcaatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccaccggcaacagcgcctgcaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31452 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgcaatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31453 - DNA, 267 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgacatgcaattagcaagtgcttcagttcttcccatgattttaaaatcagctcttgaacttgatctggaccgaatgttgcgtctcttggcttgttacaatatcctcacttgttcagttcgtactcaacaagatggaaaggttcagagactttatggtttggctactgtagctaa

SEQ ID NO: 31454 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcgacatgcaactagcaagtgcttcagttcttcccatgattttgaaatcagctcttgaacttgatctcttagaaatcattgctaaagctggacctggcgctcaaatttcacctatagaaattgcttctcagctaccaacaacctgatgcaccagttatgttggaccggatgttacgtctcttgactagatacaatatcctcactggtacagttcgtactcaacaagatggagaggtgcagagagtgtatggattggctactgttgctaa

SEQ ID NO: 31455 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttccccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccaccagttatgttggaccgaatgttgcgtctcttggcttgttacaatatcctcacttgttcagttcgtactcaacaagatggaaaggttcagagactttatggtttggctactgttgctaa

SEQ ID NO: 31456 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttccccatgcaattagcaagtgcttcagttcttcccatgattttaaaatcagctcttgaacttgatctcttagaaatcattgctaaagctggacctggtgctcaaatttcacctattgaaattgcttctcagctcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31457 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttccccatgcaattagcaagtgcttcagttcttcccatgattttaaaatcagctcttgaacttgatctcttagaaatcattgctaaagctggacctggtgctcaaatttcacctattgaaattgcttctcagcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31458 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttccccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31459 - DNA, 312 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttccatgcaattagcaagtgcttcagttcttcccatgattttaaaatcagctcttgaacttgatctcttagaaatcattgctaaagctggacctggtgctcaccagttatgttggaccgaatgttgcgtctcttggcttgttacaatatcctcacttgttcagttcgtactcaacaagatggaaaggttcagagactttatggtttggctactgttgctaa

SEQ ID NO: 31460 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcaccatgcaattagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31461 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcaccatgcaattagcaagtgcttcagttcttcccatgattttaaaatcagctcttgaacttgatctcttagaaatcattgctaaagctggacctggtgctcaaatttcacctatttaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31462 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcaccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31463 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcaccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31464 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcaccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31465 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcaccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31466 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcaccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31467 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31468 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttgaaatcagctcttgaacttgatctcttagaaatcattgctaaagctggacctggtgctcaaatttcacctattgaaattgcttctcagctcccaacagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31469 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31470 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31471 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31472 - DNA, 269 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcaccatgcaactagcaagtgcttcagttcttcccatgattttaaaatcagctctgcaccagttatgttggaccgaatgttgcgtctcttggcttgttacaatatcctcacttgttcagttcgtactcaacaagatggaaagattcagagactttatggtttggctactgttgctaa

SEQ ID NO: 31473 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttcaccatgaaattagcaagtgcttcagttcttcccatgattttaaaatcagctctttaacttgatctcttagaaatcaatgctaaagctgaacttggttctcaaatttcgcctattgaaattgcttctcagctaccaacagctgatgcaccagttatgtggaaccgaatgttgcgtctcttggcttgttacaatatcctcccttgttcagttcgtactcaacaagatggaaaggttcagagactttatggtttggctactgatgctaa

SEQ ID NO: 31474 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttagccatgcaattagcaagtgcttcagttcttcccatgattttgaaatcagctcttgaacttgatctcttagaaatcattgctaaagctggtcctggtgctcaaatttcacctattgaaattgcttctcagctcccaacatgcaccagttatgttggaccgaatgttgcgtctcttggcttgttccaatatcctcacttgttcagttcgtactcaacaagattgaaatgttcagagactttatggtttggctactgttgctaa

SEQ ID NO: 31475 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttagccatgcaactagcaagtgcttcagttcttcccatgattttgaaatcagctcttgaacttgatctcttagaaatcattgctaaagcttgacctggtgctcaaatttcacctattgacttgttacaatatcctcacttgttcagttcgtactcaacaagatggaaaggttcagagactttatggtttggctactgttgctaa

SEQ ID NO: 31476 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcttagccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31477 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctccgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgttggaccgaatgttgcgtctcttggcttgttacaatatcctcacttgttcagttcgtactcaacaagatggaaaggttcagagactttatggtttggctactgttgctaa

SEQ ID NO: 31478 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctccgccatgcaactagcaagtgcttcagttcttcccatgattttgaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31479 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctccgccatgcaactagcaagtgcttcagttcttcccatgattttgaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31480 - DNA, 412 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctacgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaggcgctggagacggtgcaggcgctgttgccggtgctgtgccaggcccacctgatgcaccagtcatgttggaccgaatgttgtgtctcttggcttgttacaatatcctcacttgttctgttcgtactcaacaagatggaaaggttcagagactttatggtttggctactgttgctaa

SEQ ID NO: 31481 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctacgccatgcaattagcaagtgcttcagttcttcccatgattttaaaatcagctcttgaacttgatctcttagaaatcattgctaaagctggacctggtgctcaaatttcacctattgaaatttcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31482 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctctacgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31483 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcgtcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaaggttcagagactttatggtttggcactgttgctaa

SEQ ID NO: 31484 - DNA, 204 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcgccatgcaactagcaagtgcttcagttcttcccatgattttgaaatcagctcttgaacttgatctacaagatggaaagattcagagactttatggtttggctactgttgctaa

SEQ ID NO: 31485 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcctcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttattttggaccgaatgttgcgtctcttggcttgttacaatatcctcactggttcagttcgtactcaagaagatggaaaggttcagagactttatggtttggctactgttgctaa

SEQ ID NO: 31486 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcctcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31487 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcctcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31488 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcctcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31489 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcctcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31490 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctccgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgcta

SEQ ID NO: 31491 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcatcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31492 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctcatcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31493 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctattcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31494 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctattcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31495 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctattcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31496 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctattcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31497 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctattcgccatgcaattagcaagtgcttcagttcttcccatgattttaaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31498 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctattcgccatgcaattagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31499 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctattcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31500 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctattcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31501 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctattcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31502 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctattcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31503 - DNA, 340 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacctattcgccatgcaactagcaagtgcttcagttcttcccatgattttaaaatcagctcttgaacttgatctcttagaaatcattgctaaagctggacctggtgctcaaatttcacctattgaaatctgatgcaccagttatgttggaccgaatgttgcgtctctttgcttgttacaatttcctcacttgttcagttcgtactcaacaagatggaaaggttcagagactttatggtttggctactgttgctaa

SEQ ID NO: 31504 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaaccgcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaggatggaaaagttcagagactttatgatttggctactgttgctaa

SEQ ID NO: 31505 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaaccccttcgccatgcaattagcaagtgcttcagttcttcccatgattttgaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31506 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaaccccttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31507 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaaccccttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31508 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaaccacttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31509 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaaccacttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31510 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacatcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31511 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacatcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 31512 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacatcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31513 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaacatcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31514 - DNA, 365 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaaactcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaacctgatgcaccagtcatgttggaccgaatgttgcgtctcttggcttgttacaatatcctcacttgttctgttcgtactcaacaagatggaaaggttcagagcctttatggtttggctactgttgctaa

SEQ ID NO: 31515 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagcaaaactcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaactgatgcaccagtcatgttggaccgaatgttgcgtctcttggcttgttacaatatcctcacttgttctgttcgtactcaacaagatggaaatgttcagagactttatggtttggctactgttgctaa

SEQ ID NO: 31516 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagagaacctcttcgacatgcaattagcaaatgcttcagttcttcccatgattttaaaatcagctcttgaacttgatctcttagaaatcattgctaaatctggacctggtgctcaaatttcacctattgaaattgcttctcagctcccaaccttatgcaccagttatgttggaccgaatgttgcgtctcttggcttgttacaatatcctcactttttcaattcttactcaacaatatgtaaaggttcagagacttttgttcggctactgttgctaa

SEQ ID NO: 31517 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagaaaacctcttcgtcatgcaactagcaagagcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgtatgttgcgtctcttggcttgttacaatttcctcacttgttcagttcgtactcaacaagatggaaaggttcagagactttatggtttggctactgttgctaa

SEQ ID NO: 31518 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagaaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcctgatgcacccgttatgttggaccgaatgttgcgtctcttggcttgttacaatatcctcacttgttcagttcgtactcaacaagatggaaaggttcagagcctttatggtttggctactgttgctaa

SEQ ID NO: 31519 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagaaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 31520 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaagaaaacctcttcgccatgcaattagcaagtgcttcagttcttcccatgattttaaaatcagctcttgaacttgatctcttagaaatcattgctaaagcgggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31521 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaccaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31522 - DNA, 438 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaccaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaccccaggaggtggtggccatcgccagcaatgggggtgggaagcaggcgctggagacggtccagcggctgttgccggtgcctgatgcaccagttattttggaccgaatgttgcgtctcttggcttgttacaatatcctcacttgttcaattcgtactcaaccagatggaaaggttaagagactttatggtttggctactgttgctaa

SEQ ID NO: 31523 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaccaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31524 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaccaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31525 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaccaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31526 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaattagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaaggttcagagactttatggtttggctactgttgctaa

SEQ ID NO: 31527 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgaaccagttatgttggaccgaatgttgcgtctcttggcttgttacaatatcctcacttgttcagttcgtactcaacaagatggaaaggttcagagactttatggtttggctactgttgctaa

SEQ ID NO: 31528 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31529 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31530 - DNA, 353 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31531 - DNA, 345 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaatcattgctaaagctggacctggtgctcaaatttcacctattgaaattgcttctcatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31532 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31533 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31534 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31535 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactggcacagcaccggcaacagccgctggaccgtctccagcaccagttatgttggaccgaatgttgcgtctcttggcttgttacaatatcctcacttgttcagttcgtactcaacaagatggaaaggttcagagactttatggtttggctactgttgctaa

SEQ ID NO: 31536 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31537 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31538 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31539 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttgaaatcagctcttgaacttgatctcttagaaatcattgctaaagctggacctggtgctcaaatttcaccaattgaaattgcttctcagctaccaacaacctgatgcaccagttatgttggaccgaatgttgcgtctcttggcttgttacagtatccgcacttgttcagttcgtactcaacaagatggaaaggttcagagactttatggtttggctacggttgctaa

SEQ ID NO: 31540 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31541 - DNA, 341 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttaaaatcagctcttgaacttgatctcttagaaatcattgctaaagctggacctggtgctcaaatttcacctattgaaattctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31542 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcgccatgcaactagcaagtgcttcagttcttcccatgattttaaaatcagctcttgaactcgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31543 - DNA, 321 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaacctcttcaccatgcaattaacaagttcttcagttcttcccatgattttaaaatcagctcttcaacttgatctcttagaaatcattgctaaagctcgaactggtcctcctattgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31544 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaagaaacaaaccccttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31545 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaacaagcaaacctcttcgccatgcaactagcaatggcgtcagttcttcccatgattttgaaatcagctcttgaactagatctcttagaaatcattcctaaagctggacctggtgctcaaatttctcctattgaaattgctgctcagctaccaacaaccctgatgcgccagttaggttggaccgaatgtggcgtatctgggcttgttacaatatcctcacttgttcagttcatacgcaacaagatggaaaggttcagagactttatggtttggctactggtgctaa

SEQ ID NO: 31546 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaacaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaagattcagagactttatggtttggctatgttgctaa

SEQ ID NO: 31547 - DNA, 329 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaaaaagcaaacctcttcgccatgcaactagcaagtgcttcagttcttcccatgattttgaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31548 - DNA, 367 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatgaaaaagcaaacctcttcgcaatgcaactagcaaaggcttcagttcttcccattattttgaaatcagctcttgaacttgatctcttagcaatcattgctaaagctggacctggtgctcaaatttcacctcttgaacttgcttctcagctaccaacaactaaaccctgatgcaccagttatgttggatcgaatgttgcgtctcttggcttgttacaatatcctcacttgttcaggtcgtcctcaacaagatggaaaggttcagagactttatggtttggctactgttgctaa

SEQ ID NO: 31549 - DNA, 302 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatcaagaagcaaacctcttcgccatgcaattagcaagtgcttcagttcttcccatgattttaaaatcagctcttgaacttgatctcttagaaatcattgctaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31550 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagatcaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31551 - DNA, 349 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagataaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactttatgttggaccgaatgttgcgtctcttggcttgttacaatatcctcacttgttcagttcgtactcaacaagatggaaaggttcagagactttatggtttggctactgttgcta

SEQ ID NO: 31552 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagataaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31553 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagataaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31554 - DNA, 296 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagataaagaagcaaacctcttcgccatgcaactagcaagtgcttcagttcttcccatgattttgaaatcagctctttaacttgatctcttagaaatcattgctaaagctggacctggtgctcaaatttcacctattgaaattgttacaatatcctcacttgttcagttcgtactcaacaagatggaaaagttcagagactttatggtttggctactgttgctaa

SEQ ID NO: 31555 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagataaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31556 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagataaagaagcaaacctcttcgccatgcaactagcaagtgcttcagttcttcccatgattttaaaatcagctcttgaacttgatctcttagaaatcattgctaaagctggacctggtgctcaaatttcacctattaaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31557 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagaggaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31558 - DNA, 352 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagacgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactaattatgttggaccgaatgttgcgtctcttggcttgttacaatatcctcacttgttcagttcgtactcaacaagatggaaagattcagagactttatggtttggctactgttgctaa

SEQ ID NO: 31559 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagacgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31560 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagacgaagaagcaaacctcttcgccatgcaactagcaagtgcttcagttcttcccatgattttgaaatcagctcttgaacttgatctcttagaaatcattgctaaagctggacctggtgctcaaatttcgcctattgaaattgcttctcagctaccaacaaatgcaccagttatgttggaccgaatgttgcgtcgcttggcttgttacaatatcctcacttgttcagttcgtactcaacaagagggaaaggttcagagactttatggtttggctactgttgataa

SEQ ID NO: 31561 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagaagaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31562 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagaagaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31563 - DNA, 363 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagaagaagaagcaaacctcttcgccatgcaattagcaagtgcttcagttcttcccatgattttaaaatcagctcttgaacttgatctcttagaaatcattgctaaagctggaactggtgctcaaatttcacctattgaaattgcttctcagctaccaacaactactgatgcaccagttatgttggaccgaatgttgcgtctcttggcttgttacaatatcctcacttgttcagttcatactcaacaagatggaaaagttcagagactttatggtttggctactgttgctaa

SEQ ID NO: 31564 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatatcagaagaagaagcaaacctcttcgccatgcaattagcaagtgcttcagttcttcccatgattttaaaatcagctcttgaacttgatatcttagaaatcattgctaaagctggacctggtgctcaaatttcacctattgaaattgcttctcagctcccaacaactagcgcctgcttgccgccgtggtggctggcgctgggcaccgcctggtccggggtcaagccgtgggcctggcacagccccggcaacagccgctggaccgtctccagcgcctgatgcaccagttatgttggaccgaatgttgcgtctcttggcttgttacaatatcatgacatgttcagttcgtactcaacaagatggaaaggttcagagacagtatggtttggggactgatgctaa

SEQ ID NO: 31565 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcaaatgaagaagcaaacctcttcgccatgcaattagcaagtgcttcagttcttcccatgcttttaaaatcagctcttgaacttgatctcttagaaatcattgctaaagctggacctggtgctcaaatttcacctattgaaattgcttctcagatcccaacaactgatgcaccagttatgttggaccgaatgttgcgtctcttggcttgttacaatatcctcacttgttcagtgcgtactcaacaagatggaaagattcagagactttatggtttggctactgttgctaa

SEQ ID NO: 31566 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcaaatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31567 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacatatcaaatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacagccagcgatggcggcggcaggccggcgctggagactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31568 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatatcaaatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31569 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatataagatgaagaaggaaacctcttcgctatgcaattagcaagtgcgtcagttcttcccatgattttaaaatcagctcttgaacttgatctcttagaaatcattgctgaagctggacctggtgctcaaatttcacctatttaaattgattctcagctcccaacaactgatgaaccagttatgttggatcgaatgttgcgtctcttggcatgttccaatatcctcccttgttcatttcgtacacaacaagatggacagattcagagactttatggtttggctactattgctaa

SEQ ID NO: 31570 - DNA, 469 bp, Artificial
  MsCOMT deletion introduced by TALEN pair MsCOMT_T03.1
tctcacaaaaacctcatcaatcacaaccatgggttcaacaggtgaaactcaaataacaccaacccacatataagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaaccaccctccgggccgttgcttcacaacgttcaaatccgctcccggcggatttgtcctactcaggagagcgttcaccgacaaacaacagataaaacgaaaggctcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31571 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacatataagatgaagaagcaaacctcttcgccatgcaattagcaagtgcttcagttcttcccatgattttaaaatcagctcttgaacttgatctcttagaaatcattgctaaagctggacctggtgctcaaatttcacctattgaccttgcttctcagctaccaacatgatgcaccagttatgttggaccgaatgttgcgtctcttggcttgttacaatatcctcactttttcagttcgtactcaacaagatggaaacattctgaaactttatggtttggctactgttgctaa

SEQ ID NO: 31572 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacccacatataagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgtacaatatcctcacttgttcagttcgtactcaacaagatggaaaggttcagagactttatggtttggctactgttgctaa

SEQ ID NO: 31573 - DNA, 366 bp, Artificial
  MsCOMT deletion introduced by TALEN pair MsCOMT_T03.1
tctcacaaaaacctcatcaatcacaaccatgggttcaacaggtgaaactcaaataacaccaacccacatataagatgaagaagcaaacctcttcgccatgcaattagcaagtgcttcagttcttcccatgattttaaaatcagctcttgaacttgatctcttagaaatcattgctaaagctggacctggtactctaatttcacctattgtaatttattctcagctcccaacaactaaaacctgatgcaccagttttgttggaccgaatgttgcgtctcttggcttgttacaatatcctcacttgttcagttcgtactcaacaagatggaacatttcatatactttatggtttgtctattttgctaa

SEQ ID NO: 31574 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacatataagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31575 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacatataagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcctggcttgttacaatatcctctcttgttcagttcgtactcaacaagatgggaaggttcagagactttattgtttggctactgttgctaa

SEQ ID NO: 31576 - DNA, 344 bp, Artificial
  MsCOMT deletion introduced by TALEN pair MsCOMT_T03.1
tctcacaaaaacctcatcaatcacaaccatgggttcaacaggtgaaactcaaataacaccaacccacatataagatgaagaagcaaacctcttcgccatgcaacaagcaagtgcttcagttcttcccatgattttaaaatcagctcttgaacttgatctcttagaaatcattgctaaagctggacctggtgctcaaatttcacctattgaatttgcttctcagctcccaacattttggaccgaatgttgcgtctcttggcttgttacaatatcctcactttttcagttcgtactcaacaagatggaaatattccgacactttatggtttggctacttttgctaa

SEQ ID NO: 31577 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacatagcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31578 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacataccagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31579 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaacccacataccagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaaggttcagagactttatggattggctactgttgctaa

SEQ ID NO: 31580 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacataccagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31581 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacccacataacagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31582 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaacccacataacagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaccttcagagactttatggtttggctactgttgctaa

SEQ ID NO: 31583 - DNA, 393 bp, Artificial
  MsCOMT deletion introduced by TALEN pair MsCOMT_T03.1
tctcacaaaaacctcatcaatcacaaccatgggttcaacaggtgaaactcaaataacaccaacccacataacagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccacgatgacggcaagcaggcgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31584 - DNA, 395 bp, Artificial
  MsCOMT deletion introduced by TALEN pair MsCOMT_T03.1
tctcacaaaaacctcatcaatcacaaccatgggttcaacaggtgaaactcaaataacaccaacccacataacagatgaagaagcaaacctcttcgccatgcaactagcaagtgcttcagttcttcccatgattttgaaatcagctcttgaacttgatctcttagaaatcattgctaaaactggacctggtgctcaaatttcacctatggatattgcttctcagctacaaacaacttattttcgagccagccacgatcgacattgatctatgaagcaccagttatgttggaccgaatgttgcgtctcttggcttgttacaatatcctcacttgttcagttcgtactcaacaagatggaaaagttcagagactttatggtttggctactgttgttaa

SEQ ID NO: 31585 - DNA, 439 bp, Artificial
  MsCOMT deletion introduced by TALEN pair MsCOMT_T03.1
tctcacaaaaacctcatcaatcacaaccatgggttcaacaggtgaaactcaaataacaccaacccacataacagatgaagaagcaaacctcttcgccatgcaactagcaagtgcttcagttcttcccatgattttgaaatcagctcttgaacttgatatcttagaaatcattgctaaagctggacctggtgctcaaatttcacctattgaaattgcttctcagctcccaacaactatgccggtgctgtgccaggcccacggcttgaccccggagcaggtggtggccatcgccagccacgatggcggcaagcactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31586 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacagagaagacgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttgtcttgtttcaatatcctcacttgttctgttcgtactcaacaagctggaaaagttcagagtctttatggtttggctactgttgctaa

SEQ ID NO: 31587 - DNA, 355 bp, Artificial
  MsCOMT deletion introduced by TALEN pair MsCOMT_T03.1
tctcacaaaaacctcatcaatcacaaccatgggttcaacaggtgaaactcaaataacaccaacccacacatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31588 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacacatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31589 - DNA, 277 bp, Artificial
  MsCOMT deletion introduced by TALEN pair MsCOMT_T03.1
tctcacaaaaacctcatcaatcacaaccatgggttcaacaggtgaaactcaaataacaccaacccacacatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatggaaagattcagagactttatggtttggctactgttgctaa

SEQ ID NO: 31590 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacacatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31591 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacccacacatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 31592 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaacccacacatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgacttgttacaatatcctcacttgttcagttcgtactcaacaagatggaaaggttcagagactttatggtttggctactgttgctaa

SEQ ID NO: 31593 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacacatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31594 - DNA, 357 bp, Artificial
  MsCOMT deletion introduced by TALEN pair MsCOMT_T03.1
tctcacaaaaacctcatcaatcacaaccatgggttcaacaggtgaaactcaaataacaccaacccacacatcagatgaagaagcaaacctcttcgccatgcaactagcaagtgcttcagttcttcccatgattttcaaatcagctcttgaacttgatctcttagaaatcattgctaaagctggacctggtgctcaaatttcacctattgaaattgcttctcagctcccaacacatgcaccagttatgttggaccgaatgttgcgtctcttggcttgttacaatatcctcacttgttcagttcgtactcaacaagatggaaagattcagagactttatggtttggctactgttgctaa

SEQ ID NO: 31595 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacccacacatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31596 - DNA, 260 bp, Artificial
  MsCOMT deletion introduced by TALEN pair MsCOMT_T03.1
tctcacaaaaacctcatcaatcacaaccatgggttcaacaggtgaaactcaaataacaccaacccacaaatcagatgaagaagcaaacctcttcgccatgcaactagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactgttgctaa

SEQ ID NO: 31597 - DNA, 320 bp, Artificial
  MsCOMT deletion introduced by TALEN pair MsCOMT_T03.1
tctcacaaaaacctcatcaatcacaaccatgggttcaacaggtgaaactcaaataacaccaacccaatatcagatgaagaagcaaacctcttcgccatgcaactagcaagtgcttcagttcttcccatgattttgaaatcagctcttgaacttgatctcttagaaatcattgctaaagctggacctggtgctcaaatttcaccagtcatgttggaccgaatgttgcgtctcttggcttgttacaatatcctcacttgttcagttcgtactcaacaagatggaaagattcagagactttatggtttggctactgttgctaa

SEQ ID NO: 31598 - DNA, 295 bp, Artificial
  MsCOMT deletion introduced by TALEN pair MsCOMT_T03.1
tctcacaaaaacctcatcaatcacaaccatgggttcaacaggtgaaactcaaataacaccaaccaacatatcagatgaagaagcaaacctcttcgccatgcatttagcaagtgcttcagttcttcccatgattttaaaatcagctcttgaacttgatctcttagaaatcattgctaaagctggacctggtgctcaaatttcacctattgccttgttacaatatcctcacttgttcagttcgtactcaacaagatggaaaggttcagagactttatggtttggctactgttgctaa

SEQ ID NO: 31599 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaaccaacatatcagatgaagaagcaaacctcttcgccatgcaattagcaagtgtttcagttcttcccatgattttaaaatcagctcttgaacttgatctcttagaaatcattgctaaagctggacctggtgctcaaatttcacctattgaaattgcttctcagctaccaacaactccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31600 - DNA, 364 bp, Artificial
  MsCOMT deletion introduced by TALEN pair MsCOMT_T03.1
tctcacaaaaacctcatcaatcacaaccatgggttcaacaggtgaaactcaaataacaccaaccaacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31601 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaaccaacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31602 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaaccaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31603 - DNA, 354 bp, Artificial
  MsCOMT deletion introduced by TALEN pair MsCOMT_T03.1
tctcacaaaaacctcatcaatcacaaccatgggttcaacaggtgaaactcaaataacaccaaccaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactgtatggtttggctactgttgctaa

SEQ ID NO: 31604 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaaccaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31605 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaaccaacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31606 - DNA, 362 bp, Artificial
  MsCOMT deletion introduced by TALEN pair MsCOMT_T03.1
tctcacaaaaacctcatcaatcacaaccatgggttcaacaggtgaaactcaaataacaccaaccaacatatcagatgaagaagcaaacctcttcgcaatgcaactagcaagtgcttcagttcttcccatgattttgaaataagctcttgaacttgatctcttagaaatcattgctaaagctggacctggtgctcaaatttcccctattgaaatttcttctcagctaccaacaactctgatgcaccagttatgttggaccgaatgttgcgtctcgtggcttgttacaatatcctcacttgttcagttcgtactcaacaagattgaaaggttcagagactttatggtttggctactgttgctaa

SEQ ID NO: 31607 - DNA, 235 bp, Artificial
  MsCOMT deletion introduced by TALEN pair MsCOMT_T03.1
tctcacaaaaacctcatcaatcacaaccatgggttcaacaggtgaaactcaaataacaccaacacacatatcagatgaagaagcaaacctcttcgccatgcaattagcaagtgcttcagttcttcccatgattttaaaatcagctcttgacttgttacaatatcctcacttgttcagttcgtactcaacaagatggaaaggttcagagactttatggtttggctactgttgctaa

SEQ ID NO: 31608 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaacacacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31609 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacacacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgtttcgtctcttggcttgttacaatatcctcacttgttcagttcgtactcaacaagatggaaagattcagagactttatggtttggctactgttgctaa

SEQ ID NO: 31610 - DNA, 359 bp, Artificial
  MsCOMT deletion introduced by TALEN pair MsCOMT_T03.1
tctcacaaaaacctcatcaatcacaaccatgggttcaacaggtgaaactcaaataacaccaacacacatataagaggaagaagcaaacctcttcgacatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgtatgtttcgtctctttacttgccacaagaaccgcacgggggcaggacgtactcaacaagatggaaaatttccacctctttatggtttggctactgttgctaa

SEQ ID NO: 31611 - DNA, 360 bp, Artificial
  MsCOMT deletion introduced by TALEN pair MsCOMT_T03.1
tctcacaaaaacctcatcaatcacaaccatgggttcaacaggtgaaactcaaataacaccaacacacatataagaagaagaagcaaacctcttcgccatgcaactagcaagtgcttcagttcttccaatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttccaatatcctctcttgttcagttcgtactcaacaagatggaaaatttcagagcctttatggtttggctactgttgctaa

SEQ ID NO: 31612 - DNA, 467 bp, Artificial
  MsCOMT deletion introduced by TALEN pair MsCOMT_T03.1
tctcacaaaaacctcatcaatcacaaccatgggttcaacaggtgaaactcaaataacaccaacacacatataagaagaagaagcaaacctcttcgacatgcaattagcaagtgcttcagttcttcccatgattttaaaatcagctcttgaacttgatctcttagaaatcattgctaaagctggacctggtgctcaaatttcacctattgaaattgcttctcagctaccaacaaagggtttacacacgcgcacatcgttgcgttaagcaatcacccatcttctttcctccccttccctctcttttttcctttccttatctccgcgttcccctattctacacctgatgcaccatttattttggaccgtatgtttcgtctcttttcttgccccaagacccgcacgggggcaggacgtactcaacaagatggaaattttccccctctttatggtttggctactgttgctaa

SEQ ID NO: 31613 - DNA, 361 bp, Artificial
  MsCOMT deletion introduced by TALEN pair MsCOMT_T03.1
tctcacaaaaacctcatcaatcacaaccatgggttcaacaggtgaaactcaaataacaccaacacacatataagaagaagaagcaaacctcttcgacatgcaactagcaagtgcttcagttcttaccatgattttgaaatcagctcttgaacttgatatcttagaaatcattgctaaagctggacctggtgctcaaatttcaccttttgaaatttcttctcagctaccaacaacctgatgcaccagttatgttggaccgtatgtttcgtctcttttcttgccccaagacccgcacgggggcaggccgtactcaacaagatggaaattttccacccctttatggtttggctactgttgctaa

SEQ ID NO: 31614 - DNA, 356 bp, Artificial
  MsCOMT deletion introduced by TALEN pair MsCOMT_T03.1
tctcacaaaaacctcatcaatcacaaccatgggttcaacaggtgaaactcaaataacaccaaaccacatatcagatgaagaagcaaacctctttgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 31615 - DNA, 358 bp, Artificial
  MsCOMT deletion introduced by TALEN pair MsCOMT_T03.1
tctcacaaaaacctcatcaatcacaaccatgggttcaacaggtgaaactcaaataacaccaaaccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31616 - DNA, 347 bp, Artificial
  MsCOMT deletion introduced by TALEN pair MsCOMT_T03.1
tctcacaaaaacctcatcaatcacaaccatgggttcaacaggtgaaactcaaataacaccaaaccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatgttggaccgaatgttgcgtctcttggcttgttacaatatcctcacttgttcagttcgtactcaacaagatggaaaggttcagagactttatggtttggctactgttgctaa

SEQ ID NO: 31617 - DNA, 299 bp, Artificial
  MsCOMT deletion introduced by TALEN pair MsCOMT_T03.1
tctcacaaaaacctcatcaatcacaaccatgggttcaacaggtgaaactcaaataacaccaaaccacatatcagatgaagaagcaaacctcttcgccatgcaactagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaaggttcagagactttatggtttggctactgttgctaa

SEQ ID NO: 31618 - DNA, 361 bp, Artificial
  MsCOMT deletion introduced by TALEN pair MsCOMT_T03.1
tctcacaaaaacctcatcaatcacaaccatgggttcaacaggtgaaactcaaataacacaaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31619 - DNA, 360 bp, Artificial
  MsCOMT deletion introduced by TALEN pair MsCOMT_T03.1
tctcacaaaaacctcatcaatcacaaccatgggttcaacaggtgaaactcaaataacacaaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31620 - DNA, 420 bp, Artificial
  MsCOMT deletion introduced by TALEN pair MsCOMT_T03.1
tctcacaaaaacctcatcaatcacaaccatgggttcaacaggtgaaactcaaataacaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgagcctttcgttttatctgttgtttgtcggtgaacgctctcctgagtaggacaaatccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31621 - DNA, 361 bp, Artificial
  MsCOMT deletion introduced by TALEN pair MsCOMT_T03.1
tctcacaaaaacctcatcaatcacaaccatgggttcaacaggtgaaactcaaataacaacaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31622 - DNA, 355 bp, Artificial
  MsCOMT deletion introduced by TALEN pair MsCOMT_T03.1
tctcacaaaaacctcatcaatcacaaccatgggttcaacaggtgaaactcaaataacaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31623 - DNA, 359 bp, Artificial
  MsCOMT deletion introduced by TALEN pair MsCOMT_T03.1
tctcacaaaaacctcatcaatcacaaccatgggttcaacaggtgaaactcaaataacaacaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccaccagttatgttggaccgaatgttgcgtctcttggcttgttacaatatcctcacttgttcagttcgtactcaacaagatggaaaggttcagagactttatggtttggctactgttgctaa

SEQ ID NO: 31624 - DNA, 359 bp, Artificial
  MsCOMT deletion introduced by TALEN pair MsCOMT_T03.1
tctcacaaaaacctcatcaatcacaaccatgggttcaacaggtgaaactcaaataaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctaccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31625 - DNA, 356 bp, Artificial
  MsCOMT deletion introduced by TALEN pair MsCOMT_T03.1
tctcacaaaaacctcatcaatcacaaccatgggttcaacaggtgaaactcaaataaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31626 - DNA, 338 bp, Artificial
  MsCOMT deletion introduced by TALEN pair MsCOMT_T03.1
tctcacaaaaacctcatcaatcacaaccatgggttcaacaggtgaaactcaaataaaaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatgatgcaccagttatgttggaccgaatgttgcgtctcttggcatgttacaatatcctcacttgttcagttcgtactcaacaagatggaaaagttcagagactttatggtttggctactgttgctaa

SEQ ID NO: 31627 - DNA, 362 bp, Artificial
  MsCOMT deletion introduced by TALEN pair MsCOMT_T03.1
tctcacaaaaacctcatcaatcacaaccatgggttcaacaggtgaaactcaaataaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31628 - DNA, 363 bp, Artificial
  MsCOMT deletion introduced by TALEN pair MsCOMT_T03.1
tctcacaaaaacctcatcaatcacaaccatgggttcaacaggtgaaactcaaataaaaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31629 - DNA, 356 bp, Artificial
  MsCOMT deletion introduced by TALEN pair MsCOMT_T03.1
tctcacaaaaacctcatcaatcacaaccatgggttcaacaggtgaaactcaaataaaaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31630 - DNA, 361 bp, Artificial
  MsCOMT deletion introduced by TALEN pair MsCOMT_T03.1
tctcacaaaaacctcatcaatcacaaccatgggttcaacaggtgaaactcaaataaaaccaacccacatatcagatgaagaagcaaacctcttcgccatgaaactagcaagtgcttcagttcttccaatgattttaaaatcagctcttgaacttgatctcttagaaatcattgctaaagctggacctggtgctcaaatttcacctgttcaaattgcttctcagcttccaacatcctgatgcaccagttatgttggaccgattgttgcgtctcttggcttgttacaatatcctcacttgttctgttcgtactcaacaagatggaaagattcagagactttatggtttggctactgttgctaa

SEQ ID NO: 31631 - DNA, 310 bp, Artificial
  MsCOMT deletion introduced by TALEN pair MsCOMT_T03.1
tctcacaaaaacctcatcaatcacaaccatgggttcaacaggtgaaactcaaataaaaacaacccacatatcagatgaagaagcaaacatcttcgccatgcaattagcaactgcttcagttcttcccatgattttaaaatcagctcttgaacttgatctcttagaaatcattgctaaagctggacctggtgctcaaatttctcctgttcaaattgcgtctcttggcttgttacaatatcctcacttgttctgttcgtactcaacaagatggaaagtttcagagactttatggtttggctacttttgctaa

SEQ ID NO: 31632 - DNA, 361 bp, Artificial
  MsCOMT deletion introduced by TALEN pair MsCOMT_T03.1
tctcacaaaaacctcatcaatcacaaccatgggttcaacaggtgaaactcaaagaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcatctattgaaattgcttctcagctcccaacaacctgatgcaccagttatgtgggaccgaatgttgcgtctcttggcttgttacaatatcctcacttgttcagttcgtactcaacaagatggaaagattcagagactttatcgtttggctactgttgctaa

SEQ ID NO: 31633 - DNA, 363 bp, Artificial
  MsCOMT deletion introduced by TALEN pair MsCOMT_T03.1
tctcacaaaaacctcatcaatcacaaccatgggttcaacaggtgaaactcaaacaacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31634 - DNA, 360 bp, Artificial
  MsCOMT deletion introduced by TALEN pair MsCOMT_T03.1
tctcacaaaaacctcatcaatcacaaccatgggttcaacaggtgaaactcaaacaacaccaacccacatatcagatgaagaagcaaacctcttcgccatgcaactagcaagtgcttcagttcttcccatgattttgaaatcagcgcttgaacttgatctcttagaaatcattgctaaagctggacctggtgctcaaatgtcacctattgaaattgcttctcagctcccaacaactgatgcaccagttatgttggaccgaatgttgcgtctcttggcttgttacaatatcctcacttgttcagttcgttctcaacaagatggaaaggttcagagactttatggtttgcctactgttgctaa

SEQ ID NO: 31635 - DNA, 359 bp, Artificial
  MsCOMT deletion introduced by TALEN pair MsCOMT_T03.1
tctcacaaaaacctcatcaatcacaaccatgggttcaacaggtgaaactcaaacaacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31636 - DNA, 361 bp, Artificial
  MsCOMT deletion introduced by TALEN pair MsCOMT_T03.1
tctcacaaaaacctcatcaatcacaaccatgggttcaacaggtgaaactcaaaaaacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31637 - DNA, 362 bp, Artificial
  MsCOMT deletion introduced by TALEN pair MsCOMT_T03.1
tctcacaaaaacctcatcaatcacaaccatgggttcaacaggtgaaactaagataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttaagagactttatggtttggctactggtgctaa

SEQ ID NO: 31638 - DNA, 356 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggagaggttcagagactttatggtttggctactgttgctaa

SEQ ID NO: 31639 - DNA, 359 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31640 - DNA, 355 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31641 - DNA, 359 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31642 - DNA, 362 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31643 - DNA, 356 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactaaccagttatgttggaccgaatgttgcgtctcttggcttgttacaatatcctcacttgttcagttcgtactcaacaagatggaaaggttcagagactttatggtttggctactgttgctaa

SEQ ID NO: 31644 - DNA, 438 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccccagcaggtggtggccatcgccagcaatggcggtggcaagcaggcgctggagacggtccagcggctgttgccggtgcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31645 - DNA, 474 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagcggctgttgccggtgatgtcgccggccgcgggcttgacaccggagcaggtcgtgaccatcgactgccctgctgcgtaacctcgttgctgctacataacatcaaacatcgacccctgatgcaccagttatgttggaccgaatgttgcatctcttggcttgttacaatatcctcacttgttcagttcgtactcaacaagatggaaagattcagagactttatggtttggctactgttgctaa

SEQ ID NO: 31646 - DNA, 346 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgttggaccgaatgttgcgtctcttggcttgttacaatatcctcactttttcagttcgtactcaacaagatggaaaggttcagagactttatggtttggctactgttgctaa

SEQ ID NO: 31647 - DNA, 361 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31648 - DNA, 355 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccaccagttatgttggaccgaatgttgcgtctcttggcttgttacaatatcctcacttgttcagttcgtactcaacaagatggaaagattcagagactttatggtttggctactgttgctaa

SEQ ID NO: 31649 - DNA, 354 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31650 - DNA, 358 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31651 - DNA, 361 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaac

SEQ ID NO: 31652 - DNA, 361 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31653 - DNA, 362 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaactattgaaattgcttctcagctcccaacaaccctgatgcaccagttatgttggaccgaatgttgcgtctcttggattgttaaaatatcctcacttgttcagttcgtacccaacaagatggaaagattcagagactttatggtttggctactggtgctaa

SEQ ID NO: 31654 - DNA, 360 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaattagcaagtgcgtcagttcttcccatgattttaaaatcagctcttgaacttgatctcttagaaatcattgctaaagctggacctggtgctcaaatttcacctattgaaattgcatctcagctcccaacatctgatgcaccagttatgttggaccgactgttgcgtctcttggcttgttacaatatcctcacttgttcagttcgtactcaacaagatggaaaagttcagagactttatggtttggctactgttgctaa

SEQ ID NO: 31655 - DNA, 357 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccattattttgaaatcagctcttgaacttgatctcttagaaatcattgctaaagctggacctggttgtcaaatttctcctattgaaattgcttctcagctcccagcttatgcaccagttatgttggaacggatgttggatcacttggctggttacaatatcctcacttgttcagttcgtactcagcaagagggaaaggttcagagactttaaggtttggctactgttgctaa

SEQ ID NO: 31656 - DNA, 349 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacatgttcagttcgtactcaacaagatggaaaggttcagagactgtatggtttggctactgttgctaa

SEQ ID NO: 31657 - DNA, 358 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31658 - DNA, 356 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31659 - DNA, 360 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31660 - DNA, 359 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaattttgcgtctcttggcttgttacaatatcctcacttgttcagttcctactcaacaagatggaaagattcagagactttatggtttggctatgttgctaa

SEQ ID NO: 31661 - DNA, 361 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgattcaccagttatgttggaccgaatattgcgtctcttggcttgttacaatatcctcacttgttcagttcgtactcaacaagatggaaaggttcagagactttatggtttggctactgttgctaa

SEQ ID NO: 31662 - DNA, 361 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttctgttcgtactcaacaagatggaaaggttcagagactttatggtttggctactggtgctaa

SEQ ID NO: 31663 - DNA, 353 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31664 - DNA, 350 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31665 - DNA, 360 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatcattgctaaagctggacctggtactcaaatttcacctattgaaattgcttctcagctaccaacaaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31666 - DNA, 352 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttgaaatcagctcttgaacttgatatcttagaaatcattgctaacgctggacctggtgctcaaatttcacctattgaaattgcttctcagctaccaacaaccagttatgttggaccgaatgttgcgtctcttggcttgttacaatatcctcacttgttcagttcgtactcaacaagatggaaaggttcagagactttatggtttggctactgttgctaa

SEQ ID NO: 31667 - DNA, 360 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31668 - DNA, 361 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31669 - DNA, 361 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31670 - DNA, 360 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagtgcttcagttcttcccatgattttaaaatcagctcttgaacttgatctcttagaaatcattgctaaagctggacctggagctcaaatttcacctattgaaattgcttctcagctaccaacagctgatgcaccagttatgttggaccgaatgttgagtcgcttggcttggtacaatatcctcacttgttcagttcgtactcaacaagatggaaaggttcagagacgttatggtttggctactgttgctaa

SEQ ID NO: 31671 - DNA, 361 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagggcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31672 - DNA, 359 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctcttcgccatgcaactagcaagggcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31673 - DNA, 361 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaagaagcaaacctctccgccatgcaattaccaagtgcttcagtctttcccattattttgaaatcagctcttgaacttgatctcttagaaatcattgctaaagctggacctggtactcaaatttcacctattgaaattgcttctcagcacccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31674 - DNA, 360 bp, Artificial
  MsCOMT deletion introduced by TALEN pair MsCOMT_T03.1
tctcacaaaaacctcatcaatcacaaccatgggttcaacaggtgaaactaaaataacaccaacccacatatcagatgaaaaaacaaaccttttcgccataaaacgagcaagttcttcagttcttcccatgtttgtgaaatcagctcttgaacgttatctcttagaactcattgctaaagctggacctggtgctcaactttctcctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31675 - DNA, 359 bp, Artificial
  MsCOMT deletion introduced by TALEN pair MsCOMT_T03.1
tctcacaaaaacctcatcaatcacaaccatgggttcaacaggtgaaactaaaataacacaaacccacatatcagatgaagaagaaaacctcttcgccatgcaactagcaagtgcttcagttcttcccatgattttgaaatcagctctagaacttgatctcttagaaatcattgctaaagctggaccatgtactcaaatttcttctattgaaattgcttctcagctcccaacaactgatgcacagttatgttggaccgaatgatgcgtctcttggccagctacaatatccacaatagttcagttcgtcctaaaaaagatggaaaggttcagagactttatggtttggctactggtgctaa

SEQ ID NO: 31676 - DNA, 349 bp, Artificial
  MsCOMT deletion introduced by TALEN pair MsCOMT_T03.1
tctcacaaaaacctcatcaatcacaaccatgggttcaacaggtgaaacgcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctctcttgttcagttcgtactcaacaagatggaaaggttcagagactttatggtttggctactgttgctaa

SEQ ID NO: 31677 - DNA, 360 bp, Artificial
  MsCOMT deletion introduced by TALEN pair MsCOMT_T03.1
tctcacaaaaacctcatcaatcacaaccatgggttcaacaggtgaaacgcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31678 - DNA, 360 bp, Artificial
  MsCOMT deletion introduced by TALEN pair MsCOMT_T03.1
tctcacaaaaacctcatcaatcacaaccatgggttcaacaggtgaaacccaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31679 - DNA, 235 bp, Artificial
  MsCOMT deletion introduced by TALEN pair MsCOMT_T03.1
tctcacaaaaacctcatcaatcacaaccatgggttcaacaggtgaaacccaaataacaccaacccacatatcagatgaagaagcaaacctcttcgccatgcaattagcaagtgcttcagttcttcccatgattttaaaatcagctcttgacttgttacaatatcctcacttgttcagttcgtactcaacaagatggaaaggttcagagactttatggtttggctactgttgctaa

SEQ ID NO: 31680 - DNA, 353 bp, Artificial
  MsCOMT deletion introduced by TALEN pair MsCOMT_T03.1
tctcacaaaaacctcatcaatcacaaccatgggttcaacaggtgaaacccaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 31681 - DNA, 360 bp, Artificial
  MsCOMT deletion introduced by TALEN pair MsCOMT_T03.1
tctcacaaaaacctcatcaatcacaaccatgggttcaacaggtgaaacccaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31682 - DNA, 361 bp, Artificial
  MsCOMT deletion introduced by TALEN pair MsCOMT_T03.1
tctcacaaaaacctcatcaatcacaaccatgggttcaacaggtgaaacccaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 31683 - DNA, 358 bp, Artificial
  MsCOMT deletion introduced by TALEN pair MsCOMT_T03.1
tctcacaaaaacctcatcaatcacaaccatgggttcaacaggtgaaacccaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacttgcaccagttatgttggaccgaatgttgcgtctcttggcttgttacaatatcctcacttgttcagttcgtactcaacaagatggaaaggttcagagactttatggtttggctactgttgctaa

SEQ ID NO: 31684 - DNA, 359 bp, Artificial
  MsCOMT deletion introduced by TALEN pair MsCOMT_T03.1
tctcacaaaaacctcatcaatcacaaccatgggttcaacaggtgaaacccaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31685 - DNA, 360 bp, Artificial
  MsCOMT deletion introduced by TALEN pair MsCOMT_T03.1
tctcacaaaaacctcatcaatcacaaccatgggttcaacaggtgaaacccaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31686 - DNA, 361 bp, Artificial
  MsCOMT deletion introduced by TALEN pair MsCOMT_T03.1
tctcacaaaaacctcatcaatcacaaccatgggttcaacaggtgaaacccaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31687 - DNA, 361 bp, Artificial
  MsCOMT deletion introduced by TALEN pair MsCOMT_T03.1
tctcacaaaaacctcatcaatcacaaccatgggttcaacaggtgaaacccaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttattgtttggctactgttgctaa

SEQ ID NO: 31688 - DNA, 248 bp, Artificial
  MsCOMT deletion introduced by TALEN pair MsCOMT_T03.1
tctcacaaaaacctcatcaatcacaaccatgggttcaacaggtgaaacccaaataacaccaacccacatatcagatgaagaagcaaacctcttcgccatgcaactagcaagtgcttcagttcttcccatgattttatgttggaccgaatgttgcgtctcttggcttgttacaatatcctcacttgttcagttcgtactcaacaagatggaaagattcagagactttatggtttggctactgttgctaa

SEQ ID NO: 31689 - DNA, 355 bp, Artificial
  MsCOMT deletion introduced by TALEN pair MsCOMT_T03.1
tctcacaaaaacctcatcaatcacaaccatgggttcaacaggtgaaacccaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctagctaa

SEQ ID NO: 31690 - DNA, 361 bp, Artificial
  MsCOMT deletion introduced by TALEN pair MsCOMT_T03.1
tctcacaaaaacctcatcaatcacaaccatgggttcaacaggtgaaacccaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31691 - DNA, 329 bp, Artificial
  MsCOMT deletion introduced by TALEN pair MsCOMT_T03.1
tctcacaaaaacctcatcaatcacaaccatgggttcaacaggtgaaacacaaataacaccaacccacatatcagatgaagaagcaaacctcttcgccatgcaattagcaagtgcttcagttcttcccatgattttaaaatcagctcttgaacctgatctcttagaaatcattgctaaagctggacctggtgctcaaatttcacctattgaaattgcttcttggaccgaatgttgcgtctcttggcttgttacaatatcctcacttgttcagttcgtactcaacaagatggaaaggttcagagactttatggtttggctactgttgctaa

SEQ ID NO: 31692 - DNA, 358 bp, Artificial
  MsCOMT deletion introduced by TALEN pair MsCOMT_T03.1
tctcacaaaaacctcatcaatcacaaccatgggttcaacaggtgaaacacaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31693 - DNA, 357 bp, Artificial
  MsCOMT deletion introduced by TALEN pair MsCOMT_T03.1
tctcacaaaaacctcatcaatcacaaccatgggttcaacaggtgaaacacaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31694 - DNA, 353 bp, Artificial
  MsCOMT deletion introduced by TALEN pair MsCOMT_T03.1
tctcacaaaaacctcatcaatcacaaccatgggttcaacaggtgaaacacaaataacaccaacccacatatcagatgaagaagcaaaactcttcgccatgcaactagcaagtgcttcagttcttcccatgattttgaaatcagctcttgaacttgatctcttagaaatcattgctaaagctggacctggtgctcaaatttcacctattgaaattacttctcagcccctgatgctccagttatgttggttcgaatgttgcgtctcgtggcttgttacaatatcctcacttgttcagttcctcctcaacaagatggaaaggttcagagactttatggtttggctactgtagataa

SEQ ID NO: 31695 - DNA, 360 bp, Artificial
  MsCOMT deletion introduced by TALEN pair MsCOMT_T03.1
tctcacaaaaacctcatcaatcacaaccatgggttcaacaggtgaaaatcaaataacaccaacccacatatcagatgaagaagcaaatctcttcgtcatgcaattagcaagtgcttcagttcttcccatgattttaaaatcagctcttggacttgatgtcttataaatcattgctaaagctggacctggtgctcaagtttcacctcttgaaattgcttctgagctaccaacaactgatgcaccagttatgttggaccgaatgttgcgtctcttggcttgttacaatatcctaccttcttcagttcgtactcaacaagatggaaacgttcagagactttatggtttggctactgttactaa

SEQ ID NO: 31696 - DNA, 403 bp, Artificial
  MsCOMT deletion introduced by TALEN pair MsCOMT_T03.1
tctcacaaaaacctcatcaatcacaaccatgggttcaacaggtgaaaatcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaacgcaaaaaggccatccgtcaggatggccttctgcttagctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31697 - DNA, 359 bp, Artificial
  MsCOMT deletion introduced by TALEN pair MsCOMT_T03.1
tctcacaaaaacctcatcaatcacaaccatgggttcaacaggtgaaaatcaaataacaccaacccacatataagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgatgcaccagttatgttgtgccgaatgttgcgtctcttggcttgttacaatatcctcacttgttcagttcgtactcaacaatatggaaagattcagagactttatggtttggctacttttgctaa

SEQ ID NO: 31698 - DNA, 361 bp, Artificial
  MsCOMT deletion introduced by TALEN pair MsCOMT_T03.1
tctcacaaaaacctcatcaatcacaaccatgggttcaacaggtcaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaactgatgcaccagttatgttggaccgtatgttgcgtctcttggcttgttacaatatcctcacttgttcagttcgtactcaacaagatggaaagattcagagactttatggtttggctactgttgctaa

SEQ ID NO: 31699 - DNA, 358 bp, Artificial
  MsCOMT deletion introduced by TALEN pair MsCOMT_T03.1
tctcacaaaaacctcatcaatcacaaccatgggttcaacaggtaaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31700 - DNA, 335 bp, Artificial
  MsCOMT deletion introduced by TALEN pair MsCOMT_T03.1
tctcacaaaaacctcatcaatcacaaccatgggttcaacaggtaaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgttgcgtctcttggcttgttacaatatcctcacttgttcagttcgtactcaacaagatggaaagattcagagactttatggtttggctactgttgctaa

SEQ ID NO: 31701 - DNA, 360 bp, Artificial
  MsCOMT deletion introduced by TALEN pair MsCOMT_T03.1
tctcacaaaaacctcatcaatcacaaccatgggttcaacaggtaaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31702 - DNA, 360 bp, Artificial
  MsCOMT deletion introduced by TALEN pair MsCOMT_T03.1
tctcacaaaaacctcatcaatcacaaccatgggttcaacaggtaaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31703 - DNA, 359 bp, Artificial
  MsCOMT deletion introduced by TALEN pair MsCOMT_T03.1
tctcacaaaaacctcatcaatcacaaccatgggttcaacaggtaaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31704 - DNA, 362 bp, Artificial
  MsCOMT deletion introduced by TALEN pair MsCOMT_T03.1
tctcacaaaaacctcatcaatcacaaccatgggttcaacaggtaaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31705 - DNA, 357 bp, Artificial
  MsCOMT deletion introduced by TALEN pair MsCOMT_T03.1
tctcacaaaaacctcatcaatcacaaccatgggttcaacaggggaaactcaaataacaccgacccacatatcagatgaagaagcagacctcttcgccatgcaactagcaagtgcttcagttcttcccatgattttgaaatcagctcttgaacttgatctcttagaaatcatcgctaaagctggacctggtgctcaaatttcacctattgaaattgcttctcagctcccaagtgatgcaccagttatgtcggaaccaatgttgcgtctcttggattgttacaatatcctcacttgttaagttcgtcctcaacaagatggaaagacacagagactttatggtttggctactgttgcaaa

SEQ ID NO: 31706 - DNA, 360 bp, Artificial
  MsCOMT deletion introduced by TALEN pair MsCOMT_T03.1
tctcacaaaaacctcatcaatcacaaccatgggttcaacaggggaaactcaaataacaccaccccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31707 - DNA, 363 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaataagcaaacctcttcgccatgcaattaacaagtgcttcagtttttcccatgattttaaaatcagctcttgaacttgctctcttagaaatcatggctaaagctggacctgttgctcaaatttcacctattgaaattgcttcacagctaccaacaaaccctaatgcaccagttatgttggaccgaatgttgcgtctcctggattgttacaatatcctcacttattcagttcgtactcaacaagatggaaagattcagagactttatggtttggctactgttgctaa

SEQ ID NO: 31708 - DNA, 360 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcagacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31709 - DNA, 355 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttcagttcgtactcaacaagatggaaagattcagagactttatggtttggctactgttgctaa

SEQ ID NO: 31710 - DNA, 349 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaagattcagagactttatggtttggctactgttgcaaa

SEQ ID NO: 31711 - DNA, 248 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaaagttcagagactttatggtttggctactgttgctaa

SEQ ID NO: 31712 - DNA, 358 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaccttttgaaattgcttctcagctcccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31713 - DNA, 359 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31714 - DNA, 357 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31715 - DNA, 393 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagccagcaatggcggcggcaggccggcgctggagactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31716 - DNA, 359 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31717 - DNA, 361 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcaaccagatggaaagattcagagactttatggtttggctactgttgctaa

SEQ ID NO: 31718 - DNA, 358 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31719 - DNA, 361 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtcacttggcttgttacaatatcctcacttgttcagttcgtactcaacaagatggaaaggttcagagactttatggtttggctactgttgctaa

SEQ ID NO: 31720 - DNA, 434 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttagcgcctcaaatagatcctgttcaggaaccggatcaaagagttcctccgccgctggacctaccaaggcaacgctatgttctcttgcttttgtcagcaagattgcgtctcttggcttgttacaatatcctcacttgttcagttcgtactcaacaagatggaaagattcagagactttatggtttggctactgttgctaa

SEQ ID NO: 31721 - DNA, 362 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31722 - DNA, 362 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcccttgttcagttcgtcctcaacaagatggaaaggttcagagcctttatggtttggctactgttgctaa

SEQ ID NO: 31723 - DNA, 361 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31724 - DNA, 361 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggtacagagactttatggtttggctactgttgctaa

SEQ ID NO: 31725 - DNA, 362 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaaccagatggaaaggttcagagactttatggtttcgctactgttgctaa

SEQ ID NO: 31726 - DNA, 356 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctccacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31727 - DNA, 357 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctattggcttgttacaatatcctcacttgttcagttcgtactcaacaagatggaaagattcagagactttatggtttggctactgttgctaa

SEQ ID NO: 31728 - DNA, 357 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31729 - DNA, 361 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31730 - DNA, 360 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31731 - DNA, 359 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31732 - DNA, 365 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31733 - DNA, 358 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31734 - DNA, 340 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31735 - DNA, 360 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattagcaagtgcttaagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31736 - DNA, 351 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaattaacaagtgcttcagttcttcccatgattttaaaatcagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31737 - DNA, 361 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcgcatgattttgaaatcagctgttgaacttgatctcttagaaatcattgctaaagctggacttggtgctcaaatttcacctattgaaattgcttctcagatcccaacaatctgatgcaccatttatgttgtacccaatatttcgtctcttgtctttttacaatatcctcacttcttcacttcctactcaacaatatacaaatgttcagagactttatggtttctctacttttactaa

SEQ ID NO: 31738 - DNA, 461 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcaccttttgaaattgcttctcagctaccaacaactacggatacactagaagaacaatatatggtagcagcgctcgggtgaaaccagtaaccctaggaaaaagagttgatatatctagaaccggcgaacaaacccccggtgcaccagatatgttggaccgaatgttgcgtagcttggcttgttacaatatcctcacttgttcagttcgtactcaaccagatggaaaggttcagagactttatggtttggctactggtgctaa

SEQ ID NO: 31739 - DNA, 361 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31740 - DNA, 295 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgacttgttacaatatcctcacttgttcagttcgtactcaacaagatggaaagattcagagactttatggtttggctactgttgctaa

SEQ ID NO: 31741 - DNA, 367 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcatctcccaacaactaaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31742 - DNA, 356 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31743 - DNA, 355 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31744 - DNA, 361 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31745 - DNA, 359 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31746 - DNA, 355 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31747 - DNA, 358 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31748 - DNA, 357 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcgtgttacaatatcctcacttgttcagttcgtactcaacaagatggaaaagttcagagactttatggtttggctactgttgctaa

SEQ ID NO: 31749 - DNA, 357 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31750 - DNA, 361 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31751 - DNA, 360 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31752 - DNA, 360 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31753 - DNA, 403 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcgtaaccgtatcgatatgctctcaaccggcattaaaagcccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31754 - DNA, 361 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31755 - DNA, 361 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31756 - DNA, 349 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaacagttatgttggaccgaatgttgcgtctcttggcttgttacaatatcctcacttgttctgttcgtactcaacaagatggaaaggttcagagactttatggtttggctactgttgctaa

SEQ ID NO: 31757 - DNA, 358 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagataccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31758 - DNA, 352 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaaccagtcatgttggaccgaatgttgcgtctcttggcttgttacaatatcctcccttgttctgttcgtactcaacaagatggaaaggttcagagactttatggtttggctactgttgctaa

SEQ ID NO: 31759 - DNA, 355 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccaccagttatgttggaccgaatgttgcgtctcttggctggttacaatatcctcacttgttcagttcgtactcaacaagatggaaaggttcagagactttatggtttggctactgttgctaa

SEQ ID NO: 31760 - DNA, 354 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31761 - DNA, 362 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttctgttcgtactcaacaagatggaaaagttcagagactttatggtttggctactgttgctaa

SEQ ID NO: 31762 - DNA, 415 bp, Artificial
  MsCOMT deletion introduced by TALEN pair MsCOMT_T03.1
tctcacaaaaacctcatcaatcacaaccatgggttcaacaggggaaactcaaataacaccaacccacatatcagatgaagaagcaaacctcttcgccatgcaactagcaagtgctacagttcttcccatgattttaaaatcagctcttgaacttgatctcttagaaatcattgctaaagctggacctggtgctcaaatttcacctattgaaattgcttctcagctaccaacaactaacgccattatctccgacgcactgtaccacgcttctattattgatggtttacgctgatgctccagttatattggaccgaatgttgcgtctcttggcttgttacaatatcctcccttgttcagttcctactcaacaatatggaaaggttcagagactttatggtttggctactgttgctaa

SEQ ID NO: 31763 - DNA, 336 bp, Artificial
  MsCOMT deletion introduced by TALEN pair MsCOMT_T03.1
tctcacaaaaacctcatcaatcacaaccatgggttcaacaggggaaactcaaataacaacaacccacatatcagatgaagaagcaaacctcttcgccatgcaactagcaagtgcttcagttcttcccatgattttgaaatcagctctttaacttgatctcttagaaatcattgctaaagctggacctggtgctcaaatttctcctattgaaatttcaccagttatgttggaccgaatgttgcgtctcttggcttgttacaatatcctcacttgttcagttcgtactcaacaagatggaaaggttcagagactttatggtttggctactgttgctaa

SEQ ID NO: 31764 - DNA, 404 bp, Artificial
  MsCOMT deletion introduced by TALEN pair MsCOMT_T03.1
tctcacaaaaacctcatcaatcacaaccatgggttcaacaggggaaactaaaataacaccaacccacatatcagatgaagaagcaaacctcttcgccatgcaactagcaagtgcttcagttcttcccatgattttgaaatcagctcttgaacttgatctcttagaaatcattgctaaagctgtacctggtgctcaaatttcacctattgaaattgcttctcagctaccaacaactgggcctttcgttttatctgttgtttgtcggtgaacgctctccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31765 - DNA, 360 bp, Artificial
  MsCOMT deletion introduced by TALEN pair MsCOMT_T03.1
tctcacaaaaacctcatcaatcacaaccatgggttcaacaggggaaactaaaataacaccaacccacatatcagatgaagaagcaaacctcttcgccatgcaactagcaagtgcttcagttcttcccatgattttgaaatcagctcttgaacttgatctcttagaaatcattgctaaagctggacctgatactcaaatttcgcctattgcaattgcgtctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31766 - DNA, 356 bp, Artificial
  MsCOMT deletion introduced by TALEN pair MsCOMT_T03.1
tctcacaaaaacctcatcaatcacaaccatgggttcaacagggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgatcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31767 - DNA, 357 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 31768 - DNA, 361 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31769 - DNA, 359 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttgggccgaatgttgcgtctcttggcttgttacaatatcctcacttgttctgttcgtactcaacaagatggaaagattcagagactttatggtttggctactgttgctaa

SEQ ID NO: 31770 - DNA, 358 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31771 - DNA, 357 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 31772 - DNA, 357 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31773 - DNA, 360 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31774 - DNA, 360 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31775 - DNA, 361 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31776 - DNA, 361 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31777 - DNA, 362 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttgcaataacctcacgtgttcagttcgtgatcaacaagatggaaaggttcagagactttatggaatgggtactgttactaa

SEQ ID NO: 31778 - DNA, 357 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgctacaatatcctcacttgttcagttcgtactcaacaagatggaaaggttcagagactttatggtttggctactgttgctaa

SEQ ID NO: 31779 - DNA, 361 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31780 - DNA, 360 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31781 - DNA, 360 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31782 - DNA, 388 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccccaacgcctgcttgccaccgccacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31783 - DNA, 361 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttactaa

SEQ ID NO: 31784 - DNA, 353 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31785 - DNA, 396 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactttgtgcacgacgacatcattccgtggcgttatccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31786 - DNA, 360 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaataacctcacttgttcagttcgtactcaacaagatggaaagattccgagcctttatggtttggctactgttgcaaa

SEQ ID NO: 31787 - DNA, 353 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31788 - DNA, 360 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31789 - DNA, 364 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactccctgatgcaccagttatgttggaccgattgttgcgtctcttggcttgttacaatatcctcacttgttcagttcgtactcaacaagatggaaaggttcagagactttatggtttggctactgttgctaa

SEQ ID NO: 31790 - DNA, 362 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31791 - DNA, 329 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31792 - DNA, 350 bp, Artificial
  MsCOMT deletion introduced by TALEN pair MsCOMT_T03.1
tctcacaaaaacctcatcaatcacaaccatgggttcaacaggcgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31793 - DNA, 362 bp, Artificial
  MsCOMT deletion introduced by TALEN pair MsCOMT_T03.1
tctcacaaaaacctcatcaatcacaaccatgggttcaacaggagaaactcaaataacaccaacgcacatatcagatgaagaagcaaacctcttcgccatgcaattagcaagtgcttcagttcttcccatgattttaaaatcagctcttgaacttgatctcttagaattcattgctaaagctgaacctggtgctcaaatttcaccgattgaagttgcttctcaactcccaacaaccctgatgcaccagttatgttggaccgaatgttgcgtctcttggcttgttacaatatcctcacttgttcagttcgtactcaacaagatggaaaggttgagagactttatggtttggctactgtggctaa

SEQ ID NO: 31794 - DNA, 353 bp, Artificial
  MsCOMT deletion introduced by TALEN pair MsCOMT_T03.1
tctcacaaaaacctcatcaatcacaaccatgggttcaacaggagaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcatatttcacctattgaaattgattctcagctcccaatgcaccagttatgttggaccgaatgttgcgtctcttggcttgtaacaatatcctcacttgttcaattcgtcctcaacaagatggaaagattcagagactttatggtttggctactgttgctaa

SEQ ID NO: 31795 - DNA, 360 bp, Artificial
  MsCOMT deletion introduced by TALEN pair MsCOMT_T03.1
tctcacaaaaacctcatcaatcacaaccatgggttcaacaggagaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagcctttatggtttggctactgttgctaa

SEQ ID NO: 31796 - DNA, 361 bp, Artificial
  MsCOMT deletion introduced by TALEN pair MsCOMT_T03.1
tctcacaaaaacctcatcaatcacaaccatgggttcaacaggagaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 31797 - DNA, 357 bp, Artificial
  MsCOMT deletion introduced by TALEN pair MsCOMT_T03.1
tctcacaaaaacctcatcaatcacaaccatgggttcaacaggagaaactcaaataacaccaacccacatatcagatgaagaagcaaacctcttcgccatgcaactagcaagtgcttcagttcttcccatgattttaaaatcagctcttgaacttgatctcttagaaatcattggtaaagctggacctgatgctcaaatttcacctattgaaattgcttctcagctcccaactgatgcaccagttatgttggaccgaatggtgcgtctctgggcttgttacaatatcctcacttgttcagttcgtactcaacaagatggaaagattcagagactttatggtttggctactgttgctaa

SEQ ID NO: 31798 - DNA, 357 bp, Artificial
  MsCOMT deletion introduced by TALEN pair MsCOMT_T03.1
tctcacaaaaacctcatcaatcacaaccatgggttcaacaggagaaactcaaataacaccaacccacatatacgatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacaacctgatgcaccagttatgttggaccgaatgttgcgtcgctgggcgtgttacaagagcctcacttgttctgtgcgtatacaataagagggaaaggttcagagtcattatggtttggctactggtactaa

SEQ ID NO: 31799 - DNA, 356 bp, Artificial
  MsCOMT deletion introduced by TALEN pair MsCOMT_T03.1
tctcacaaaaacctcatcaatcacaaccatgggttcaacagctgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaagattcagagactttatggtttggctactgttgctaa

SEQ ID NO: 31800 - DNA, 329 bp, Artificial
  MsCOMT deletion introduced by TALEN pair MsCOMT_T03.1
tctcacaaaaacctcatcaatcacaaccatgggttcaacagctgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagaccgaatgttgcgtctcttggcttgttacaatatcctcacttgttcagttcgtactcaacaagatggaaagattcagagactttatggtttggctactgttgctaa

SEQ ID NO: 31801 - DNA, 360 bp, Artificial
  MsCOMT deletion introduced by TALEN pair MsCOMT_T03.1
tctcacaaaaacctcatcaatcacaaccatgggttcaacagatgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31802 - DNA, 248 bp, Artificial
  MsCOMT deletion introduced by TALEN pair MsCOMT_T03.1
tctcacaaaaacctcatcaatcacaaccatgggttcaacagatgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaaggttcagagactttatggtttggctactgttgctaa

SEQ ID NO: 31803 - DNA, 353 bp, Artificial
  MsCOMT deletion introduced by TALEN pair MsCOMT_T03.1
tctcacaaaaacctcatcaatcacaaccatgggttcaacagatgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcgcctattgaaattgcttctcagctcccaacgcaccagttatgttggaccgaatgttgcgtctcttggcttgttacaatatcctcacttgttcagttcgtactcaacaagatggaaagattcagagactttatggtttggctactgttgctaa

SEQ ID NO: 31804 - DNA, 360 bp, Artificial
  MsCOMT deletion introduced by TALEN pair MsCOMT_T03.1
tctcacaaaaacctcatcaatcacaaccatgggttcaacagatgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31805 - DNA, 361 bp, Artificial
  MsCOMT deletion introduced by TALEN pair MsCOMT_T03.1
tctcacaaaaacctcatcaatcacaaccatgggttcaacagatgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31806 - DNA, 361 bp, Artificial
  MsCOMT deletion introduced by TALEN pair MsCOMT_T03.1
tctcacaaaaacctcatcaatcacaaccatgggttcaacagatgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31807 - DNA, 362 bp, Artificial
  MsCOMT deletion introduced by TALEN pair MsCOMT_T03.1
tctcacaaaaacctcatcaatcacaaccatgggttcaacagatgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31808 - DNA, 358 bp, Artificial
  MsCOMT deletion introduced by TALEN pair MsCOMT_T03.1
tctcacaaaaacctcatcaatcacaaccatgggttcaacagatgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttccaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31809 - DNA, 353 bp, Artificial
  MsCOMT deletion introduced by TALEN pair MsCOMT_T03.1
tctcacaaaaacctcatcaatcacaaccatgggttcaacagatgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaggttctgagactttatggtttggctactgttgctaa

SEQ ID NO: 31810 - DNA, 289 bp, Artificial
  MsCOMT deletion introduced by TALEN pair MsCOMT_T03.1
tctcacaaaaacctcatcaatcacaaccatgggttcaacagatgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggaccgaatgttgcgtctcttggcttgttacaatatcctcacttgttcagttcgtactcaacaagatggaaaggttcagagactttatggtttggctactgttgctaa

SEQ ID NO: 31811 - DNA, 356 bp, Artificial
  MsCOMT deletion introduced by TALEN pair MsCOMT_T03.1
tctcacaaaaacctcatcaatcacaaccatgggttcaacaagtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31812 - DNA, 359 bp, Artificial
  MsCOMT deletion introduced by TALEN pair MsCOMT_T03.1
tctcacaaaaacctcatcaatcacaaccatgggttcaacaagtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31813 - DNA, 366 bp, Artificial
  MsCOMT deletion introduced by TALEN pair MsCOMT_T03.1
tctcacaaaaacctcatcaatcacaaccatgggttcaacaagtgaaactcaaataacaacaacccacatatcagatgaagaagcaaacctcttcgccatgcaattaacaagtgcttcagatctacccatgattttgaaatcagctcatgaactagatctcttagaaatcaatgctaaagctggacctagtgctcaaatttcacctattgaaattggttctcagctaccaacaactaacccctctgccccagttatgttggaccgaatgttgcgtctcttggcttgttacaatttccacacttgttcagttcctactaagcaagatggaaaggttcagagaatttatggtttggctactgttgctaa

SEQ ID NO: 31814 - DNA, 362 bp, Artificial
  MsCOMT deletion introduced by TALEN pair MsCOMT_T03.1
tctcacaaaaacctcatcaatcacaaccatgggttcaaaaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31815 - DNA, 360 bp, Artificial
  MsCOMT deletion introduced by TALEN pair MsCOMT_T03.1
tctcacaaaaacctcatcaatcacaaccatgggttcaaaaggagaaactaaaataacaccaacccacatatcagatgaagaagcaaacctcttcgtcatgcaattagccactgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31816 - DNA, 360 bp, Artificial
  MsCOMT deletion introduced by TALEN pair MsCOMT_T03.1
tctcacaaaaacctcatcaatcacaaccatgggttaaacaggtgaaactcaaataacaccaacccacatatcagatgaagaagcaaacctcttctccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgagtctcttggcttgttacaatatcctcacttgttcagttcgtactcaacaagatggaaaggttcagagactttatggtttggctactgttgctaa

SEQ ID NO: 31817 - DNA, 332 bp, Artificial
  MsCOMT deletion introduced by TALEN pair MsCOMT_T03.1
tctcacaaaaacctcatcaatcacaaccatgggttaaacaggggaaactcaaataacaccaacccacatataagatgaagaagcaaaccccttcgccatgcaattagcaagtgcttcagttcttcccatgattttaaaataagcttttgaacttgatctcttagaaatcattgctaaagctggacctggtgctcaaatttcacctattgaaattgcttctcagctcccaacaacttgcgtctcttggcttgttacaatatcctcacttgttcagttcgtactcaacaagatggaaaggttcagagactttatggtttggctactgttgctaa

SEQ ID NO: 31818 - DNA, 357 bp, Artificial
  MsCOMT deletion introduced by TALEN pair MsCOMT_T03.1
tctcacaaaaacctcatcaatcacaaccatgggtccaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31819 - DNA, 361 bp, Artificial
  MsCOMT deletion introduced by TALEN pair MsCOMT_T03.1
tctcacaaaaacctcatcaatcacaaccatgggtccaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31820 - DNA, 358 bp, Artificial
  MsCOMT deletion introduced by TALEN pair MsCOMT_T03.1
tctcacaaaaacctcatcaatcacaaccatgggtccaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31821 - DNA, 360 bp, Artificial
  MsCOMT deletion introduced by TALEN pair MsCOMT_T03.1
tctcacaaaaacctcatcaatcacaaccatgggtccaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagatcgtactcaacaagatggaaaggttcagagactttatggtttggctactgttgctaa

SEQ ID NO: 31822 - DNA, 357 bp, Artificial
  MsCOMT deletion introduced by TALEN pair MsCOMT_T03.1
tctcacaaaaacctcatcaatcacaaccatgggtccaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31823 - DNA, 356 bp, Artificial
  MsCOMT deletion introduced by TALEN pair MsCOMT_T03.1
tctcacaaaaacctcatcaatcacaaccatgggtccaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31824 - DNA, 361 bp, Artificial
  MsCOMT deletion introduced by TALEN pair MsCOMT_T03.1
tctcacaaaaacctcatcaatcacaaccatgggtccaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31825 - DNA, 358 bp, Artificial
  MsCOMT deletion introduced by TALEN pair MsCOMT_T03.1
tctcacaaaaacctcatcaatcacaaccatgggtccaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31826 - DNA, 351 bp, Artificial
  MsCOMT deletion introduced by TALEN pair MsCOMT_T03.1
tctcacaaaaacctcatcaatcacaaccatgggtccaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaagttcagagactttatggtttggctactgttgctaa

SEQ ID NO: 31827 - DNA, 294 bp, Artificial
  MsCOMT deletion introduced by TALEN pair MsCOMT_T03.1
tctcacaaaaacctcatcaatcacaaccatgggtccaacaggtgaaactcaaataacaccaacccacatatcagatgaagaagcaaacctcttcgccatgcaactagcaagtgcttcagttcttcccatgattttgaaatcagctcttgaacttgatctcttagaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31828 - DNA, 317 bp, Artificial
  MsCOMT deletion introduced by TALEN pair MsCOMT_T03.1
tctcacaaaaacctcatcaatcacaaccatgggtccaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgtgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31829 - DNA, 345 bp, Artificial
  MsCOMT deletion introduced by TALEN pair MsCOMT_T03.1
tctcacaaaaacctcatcaatcacaaccatgggtccaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgttggaccgaatgttgcgtctcttggcttgttacaatatcctcacttgttcagttcgtactcaacaagatggaaaggttcagagactttatggtttggctactgttgctaa

SEQ ID NO: 31830 - DNA, 360 bp, Artificial
  MsCOMT deletion introduced by TALEN pair MsCOMT_T03.1
tctcacaaaaacctcatcaatcacaaccatgggtccaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31831 - DNA, 207 bp, Artificial
  MsCOMT deletion introduced by TALEN pair MsCOMT_T03.1
tctcacaaaaacctcatcaatcacaaccatgggtccaacaggtgaaactcaaataacaccaacccacatatcagatgaagaagcaaacctcttcgccatgcaactagcaagtgcttcagttcttcccatgattttaaaatcagctcttgaacttgatctacaagatggaaagattcagagactttatggtttggctactgttgctaa

SEQ ID NO: 31832 - DNA, 356 bp, Artificial
  MsCOMT deletion introduced by TALEN pair MsCOMT_T03.1
tctcacaaaaacctcatcaatcacaaccatgggtcaaccggggaaactccaattacacccacccacatatcagatgaagaaacaaacctctttgccaagccattagcaagtgcttcagtttttcccatgattttaaaatcagctcttgaacttgatctcttagaaatcattgctaaagctggacctggtgctcaaatttcacctattgaaattgcttctcagctaccaacaattgcaccagttatgttggaccgaatgttgcgtctcttggcttgttacaatatcctcacttgttcagttcgtactcaacaagatggaaaggttcagagactttatggtttggctactgttgctaa

SEQ ID NO: 31833 - DNA, 360 bp, Artificial
  MsCOMT deletion introduced by TALEN pair MsCOMT_T03.1
tctcacaaaaacctcatcaatcacaaccatgggtcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaaatgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31834 - DNA, 360 bp, Artificial
  MsCOMT deletion introduced by TALEN pair MsCOMT_T03.1
tctcacaaaaacctcatcaatcacaaccatgggtcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctatcaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31835 - DNA, 355 bp, Artificial
  MsCOMT deletion introduced by TALEN pair MsCOMT_T03.1
tctcacaaaaacctcatcaatcacaaccatgggtcaaacggtggaacccaaataaaaacaaaccacctaacagatgaagaaacaaaaccccttgccaagccaataaccagtgcttcagttcctcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 31836 - DNA, 360 bp, Artificial
  MsCOMT deletion introduced by TALEN pair MsCOMT_T03.1
tctcacaaaaacctcatcaatcacaaccatgggtacaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgtggcgtctcttggcttgttacaatatcctcacttgttcagttcgtactcaacaagatggaaaggttcagagactttatggtttggctactgttgctaa

SEQ ID NO: 31837 - DNA, 358 bp, Artificial
  MsCOMT deletion introduced by TALEN pair MsCOMT_T03.1
tctcacaaaaacctcatcaatcacaaccatggggtcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31838 - DNA, 361 bp, Artificial
  MsCOMT deletion introduced by TALEN pair MsCOMT_T03.1
tctcacaaaaacctcatcaatcacaaccatggggtcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31839 - DNA, 294 bp, Artificial
  MsCOMT deletion introduced by TALEN pair MsCOMT_T03.1
tctcacaaaaacctcatcaatcacaaccatggggtcaacaggtgaaactcaaataacaccaacccacatatcagatgaagaagcaaacctcttcgccatgcaactagcaagtgcttcagttcttcccatgattttgaaatcagctcttgaacttgatctcttagaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31840 - DNA, 361 bp, Artificial
  MsCOMT deletion introduced by TALEN pair MsCOMT_T03.1
tctcacaaaaacctcatcaatcacaaccatggggtcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31841 - DNA, 357 bp, Artificial
  MsCOMT deletion introduced by TALEN pair MsCOMT_T03.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31842 - DNA, 359 bp, Artificial
  MsCOMT deletion introduced by TALEN pair MsCOMT_T03.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31843 - DNA, 357 bp, Artificial
  MsCOMT deletion introduced by TALEN pair MsCOMT_T03.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgtcacaatatcctcacttgttcagttcgtactcaacaagatggaaaggttcagagactttatggtttggctactgttgctaa

SEQ ID NO: 31844 - DNA, 360 bp, Artificial
  MsCOMT deletion introduced by TALEN pair MsCOMT_T03.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31845 - DNA, 360 bp, Artificial
  MsCOMT deletion introduced by TALEN pair MsCOMT_T03.1
tctcacaaaaacctcatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31846 - DNA, 270 bp, Artificial
  MsCOMT deletion introduced by TALEN pair MsCOMT_T03.1
tctcacaaaaacctcatcaatcacaaccatgggctcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgtacctggtgctcaaatttcacctattgaaattgcttctcaacaagatggaaaagttcagagactttatggtttggctactgttgctaa

SEQ ID NO: 31847 - DNA, 357 bp, Artificial
  MsCOMT deletion introduced by TALEN pair MsCOMT_T03.1
tctcacaaaaacctcatcaatcacaaccatgggctcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31848 - DNA, 360 bp, Artificial
  MsCOMT deletion introduced by TALEN pair MsCOMT_T03.1
tctcacaaaaacctcatcaatcacaaccatgggctcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 31849 - DNA, 355 bp, Artificial
  MsCOMT deletion introduced by TALEN pair MsCOMT_T03.1
tctcacaaaaacctcatcaatcacaaccatgggctcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatatgcaccagttatgttggaccgaatgttgcgtctcttggcttgttacaatatcctcacttgttcagttcgtactcaacaagatggaaaggttcagagactttatggtttggctactggtgctaa

SEQ ID NO: 31850 - DNA, 359 bp, Artificial
  MsCOMT deletion introduced by TALEN pair MsCOMT_T03.1
tctcacaaaaacctcatcaatcacaaccatgggctcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31851 - DNA, 360 bp, Artificial
  MsCOMT deletion introduced by TALEN pair MsCOMT_T03.1
tctcacaaaaacctcatcaatcacaaccatgggctcaacaggcgaaactcaaataacaccaagccacatatcagatgaagaagcaaacctcttcgccatgcaattagcaagtgcttcagttcttcccatgattttaaaatcagctcttgaacttgatctcttagaagtcattgctaaagctggacctggtgctcaaatttcacctattgaaattgcttctcagctaccaacatctgatgctccagttatgttggacagaatattgcgtctcttggcatgttacaatatcctctcttgttcagttcgtactcaacaagatggaaaggatcagagactttatggttgggcgactgttgctaa

SEQ ID NO: 31852 - DNA, 360 bp, Artificial
  MsCOMT deletion introduced by TALEN pair MsCOMT_T03.1
tctcacaaaaacctcatcaatcacaaccatgggctcaacaggcgaaactcaaataacaccaacccacatatcagatgaagaagcaaacctctgcgccatgcaattagcaagtgcttcagttcttcccatgattttaaaatcagctcttgaacttgatctcttagaaatcattgctaaagctggacctggtgctcaaatttcacctattgaaattgcttctcagctcccaacagctgatgcaccagttatgttggaccgaatgttgcgtctcttggcttgttacaatatcctcacttgttcagttcgtactcaacaagattgaatgattcagagactttatggtttggctactgttgctaa

SEQ ID NO: 31853 - DNA, 344 bp, Artificial
  MsCOMT deletion introduced by TALEN pair MsCOMT_T03.1
tctcacaaaaacctcatcaatcacaaccatgggatcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctccagttatgttggaccgaatgttgcgtctcttggcttgttacaatatcctcacttgttcagttcgtactcaacaagatggaaaggttcagagactttatggtttggctactgttgctaa

SEQ ID NO: 31854 - DNA, 358 bp, Artificial
  MsCOMT deletion introduced by TALEN pair MsCOMT_T03.1
tctcacaaaaacctcatcaatcacaaccatgggatcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31855 - DNA, 329 bp, Artificial
  MsCOMT deletion introduced by TALEN pair MsCOMT_T03.1
tctcacaaaaacctcatcaatcacaaccatgggatcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctgttgctcaaatttcactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31856 - DNA, 356 bp, Artificial
  MsCOMT deletion introduced by TALEN pair MsCOMT_T03.1
tctcacaaaaacctcatcaatcacaaccatggcttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31857 - DNA, 361 bp, Artificial
  MsCOMT deletion introduced by TALEN pair MsCOMT_T03.1
tctcacaaaaacctcatcaatcacaaccatggcttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31858 - DNA, 206 bp, Artificial
  MsCOMT deletion introduced by TALEN pair MsCOMT_T03.1
tctcacaaaaacctcatcaatcacaaccatggattcaacaggtgaaactcaaataacaccaacccacatatcagatgaagaagcaaacctcttcgccatgcaattagcaagtgcttcagttcttcccatgattttaaatcagctcttgaacttgatctacaagatggaaagattcagagactttatggtttggctactgttgctaa

SEQ ID NO: 31859 - DNA, 360 bp, Artificial
  MsCOMT deletion introduced by TALEN pair MsCOMT_T03.1
tctcacaaaaacctcatcaatcacaaccatggattcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcggctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31860 - DNA, 360 bp, Artificial
  MsCOMT deletion introduced by TALEN pair MsCOMT_T03.1
tctcacaaaaacctcatcaatcacaaccatggattcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31861 - DNA, 360 bp, Artificial
  MsCOMT deletion introduced by TALEN pair MsCOMT_T03.1
tctcacaaaaacctcatcaatcacaaccatggattcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctctaggcttgttacaatatcctcacttgttcagttcgtactcaacaagatggaaaggttcagagactttatggtttggctactgttgctaa

SEQ ID NO: 31862 - DNA, 357 bp, Artificial
  MsCOMT deletion introduced by TALEN pair MsCOMT_T03.1
tctcacaaaaacctcatcaatcacaaccatggattcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31863 - DNA, 353 bp, Artificial
  MsCOMT deletion introduced by TALEN pair MsCOMT_T03.1
tctcacaaaaacctcatcaatcacaaccatggattcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31864 - DNA, 354 bp, Artificial
  MsCOMT deletion introduced by TALEN pair MsCOMT_T03.1
tctcacaaaaacctcatcaatcacaaccatggattcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatatgcaccagttatgttggaccgaatgttgcgtctcttggcttgttacaatatcctcacttgttcagttcgtactcaacaagatggaaagattcagagactttatggtttgctactgttgctaa

SEQ ID NO: 31865 - DNA, 361 bp, Artificial
  MsCOMT deletion introduced by TALEN pair MsCOMT_T03.1
tctcacaaaaacctcatcaatcacaaccatggattcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31866 - DNA, 360 bp, Artificial
  MsCOMT deletion introduced by TALEN pair MsCOMT_T03.1
tctcacaaaaacctcatcaatcacaaccatgcgttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31867 - DNA, 361 bp, Artificial
  MsCOMT deletion introduced by TALEN pair MsCOMT_T03.1
tctcacaaaaacctcatcaatcacaaccatgagttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31868 - DNA, 361 bp, Artificial
  MsCOMT deletion introduced by TALEN pair MsCOMT_T03.1
tctcacaaaaacctcatcaatcacaaccatgagttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31869 - DNA, 355 bp, Artificial
  MsCOMT deletion introduced by TALEN pair MsCOMT_T03.1
tctcacaaaaacctcatcaatcacaaccatgagttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31870 - DNA, 289 bp, Artificial
  MsCOMT deletion introduced by TALEN pair MsCOMT_T03.1
tctcacaaaaacctcatcaatcacaaccataggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggaccgaatgttgcgtctcttggcttgttacaatatcctcacttgttcagttcgtactcaacaagatggaaagattcagagactttatggtttggctactgttgctaa

SEQ ID NO: 31871 - DNA, 365 bp, Artificial
  MsCOMT deletion introduced by TALEN pair MsCOMT_T03.1
tctcacaaaaacctcatcaatcacaaccataggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31872 - DNA, 354 bp, Artificial
  MsCOMT deletion introduced by TALEN pair MsCOMT_T03.1
tctcacaaaaacctcatcaatcacaaccataggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaagattcagagactttatggtttggctactgttgctaa

SEQ ID NO: 31873 - DNA, 289 bp, Artificial
  MsCOMT deletion introduced by TALEN pair MsCOMT_T03.1
tctcacaaaaacctcatcaatcacaaccataggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaacgtactcaacaagatggaaaggttcagagactttatggtttggctactgttgctaa

SEQ ID NO: 31874 - DNA, 360 bp, Artificial
  MsCOMT deletion introduced by TALEN pair MsCOMT_T03.1
tctcacaaaaacctcatcaatcacaaccataggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctatttaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31875 - DNA, 299 bp, Artificial
  MsCOMT deletion introduced by TALEN pair MsCOMT_T03.1
tctcacaaaaacctcatcaatcacaaccataggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaaggttcagagactttatggtttggctactgttgctaa

SEQ ID NO: 31876 - DNA, 354 bp, Artificial
  MsCOMT deletion introduced by TALEN pair MsCOMT_T03.1
tctcacaaaaacctcatcaatcacaaccagggtttcaacaggtgaaactcaattaacaccaacccacttatcagatgaagaacaaaacctcttcgccatgcaattagcaagtgcttcagttcttcccatgattttaaaatcagctcttgaacttgatctcttagaaatcattgctaaagctgaacctggtgctcaaatttcacctattgaaattgcttctcagctcccaaatgcaccagttatgttggaccgaatgttgcgtctcttggcttgttacaacagcgtcagttgtgcagttcggactcaacaagatggaaatgatcagagactttatggtttggctactgttgctaa

SEQ ID NO: 31877 - DNA, 361 bp, Artificial
  MsCOMT deletion introduced by TALEN pair MsCOMT_T03.1
tctcacaaaaacctcatcaatcacaaccaggggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31878 - DNA, 356 bp, Artificial
  MsCOMT deletion introduced by TALEN pair MsCOMT_T03.1
tctcacaaaaacctcatcaatcacaaccacgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31879 - DNA, 362 bp, Artificial
  MsCOMT deletion introduced by TALEN pair MsCOMT_T03.1
tctcacaaaaacctcatcaatcacaaccacgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcctggcttgttacaatatcctcacttgttcagttcgtactcaacaagatggaaagattcagagactttatggtttggctactgttgctaa

SEQ ID NO: 31880 - DNA, 410 bp, Artificial
  MsCOMT deletion introduced by TALEN pair MsCOMT_T03.1
tctcacaaaaacctcatcaatcacaaccacgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgaccaggaacaagcacatcaaccccaacgagtggtggaaggtgtaccccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31881 - DNA, 351 bp, Artificial
  MsCOMT deletion introduced by TALEN pair MsCOMT_T03.1
tctcacaaaaacctcatcaatcacaaccacgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgccaaagctggacctggtgctcaaatttcacctattgaaattgcttctcagctaccaacaacagttatgttggaccgaatgttgcgtctcttggcttgttacaatatcctcacttgttcagttcgtactcaacaagatggaaaagttcagagactttatggtttggctactgttgctaa

SEQ ID NO: 31882 - DNA, 362 bp, Artificial
  MsCOMT deletion introduced by TALEN pair MsCOMT_T03.1
tctcacaaaaacctcatcaatcacaaccacgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31883 - DNA, 249 bp, Artificial
  MsCOMT deletion introduced by TALEN pair MsCOMT_T03.1
tctcacaaaaacctcatcaatcacaacaatgggttcaacaggtgaaactcaaataacaccaacccacatatcagatgaagaagcaaacctcttcgccatgcaattagcaagtgcttcagttcttcccatgattttaaaatcagctcttgaacttgatctcttggcttgttacaatatcctcacttgttcagttcgtactcaacaagatggaaaggttcagagactttatggtttggctactgttgctaa

SEQ ID NO: 31884 - DNA, 346 bp, Artificial
  MsCOMT deletion introduced by TALEN pair MsCOMT_T03.1
tctcacaaaaacctcatcaatcacaacaatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgttggaccgaatgttgcgtctcttggcttgttacaatatcctcacttgttcagttcgtactcaacaagatggaaaggttcagagactttatggtttggctactgttgctaa

SEQ ID NO: 31885 - DNA, 354 bp, Artificial
  MsCOMT deletion introduced by TALEN pair MsCOMT_T03.1
tctcacaaaaacctcatcaatcacaacaatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaaggttcagagactttatggtttggctactgttgctaa

SEQ ID NO: 31886 - DNA, 360 bp, Artificial
  MsCOMT deletion introduced by TALEN pair MsCOMT_T03.1
tctcacaaaaacctcatcaatcacaacaatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggctggttacaatatcctcacttgttcaggtcgtactcaacaagatggaaaggttcagagcctttatggtttggctactgttgctaa

SEQ ID NO: 31887 - DNA, 355 bp, Artificial
  MsCOMT deletion introduced by TALEN pair MsCOMT_T03.1
tctcacaaaaacctcatcaatcacaacaatgggttcaacaggtgaaactaaaataaaacaaacacacaaataagaggaagaagcaaacctcttcgccatgcaactagcaagtgcttcagttcttcccatgattttgaaatcagctcttgaacttgatctcttagaaatcattgctaaagctggacctggtgctcaaatttcacctattgtaattatttctcagctaccaacatgcaccagttatgttggaccgactgttgcgtctcttgtcttgttccaatatcctcactttttcagttcgtactcaacaagatggaaactttcctccactttatggtttggctactgtttctaa

SEQ ID NO: 31888 - DNA, 360 bp, Artificial
  MsCOMT deletion introduced by TALEN pair MsCOMT_T03.1
tctcacaaaaacctcatcaatcacaaatatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 31889 - DNA, 358 bp, Artificial
  MsCOMT deletion introduced by TALEN pair MsCOMT_T03.1
tctcacaaaaacctcatcaatcacaaacctggtttcaacctgtgaaactcaaacaacactaacccacatatcacatgaagaaacaaacctcatcgccttgcaattatcaagtgcttcagttcttcccatgattttaaaatcagctcttgaacttgatctcttagaaatcattgctaaagctggacctggtgctccaatttcacctattgaaattgcttctcagctcccaacaacatgcaccagttatgttggaccgaatgttgcgtctcttggcttgttacaatagcctcacttgttcagttcgtactcaacaagatggaaaggttcagagactttatggtttggctactgttgctaa

SEQ ID NO: 31890 - DNA, 357 bp, Artificial
  MsCOMT deletion introduced by TALEN pair MsCOMT_T03.1
tctcacaaaaacctcatcaatcacaaacatgggttcaacaggtgaaactcagataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatatgcaccagttatgttggaccgaatgtcgcgtctcttggcttgttacaatatcctcacttgttcagttcgtactcaacaagatggaaaggttcagagactttatggtttggctactgttgctaa

SEQ ID NO: 31891 - DNA, 447 bp, Artificial
  MsCOMT deletion introduced by TALEN pair MsCOMT_T03.1
tctcacaaaaacctcatcaatcacaaacatgggttcaacaggtgaaactcaaataacaccaacccacatatcatatgaagaagcaaacctcttcgccatgcaataagcaagggcttcagttcttcccatgattttaaaatcagctcttgaacttgatctcttagaactcattgctaaatctcgacctggtgctcacatttcacctattgaaattgctactcagatcccaacaactacatacgtcagaaaccaatattgcgcgttcaaaagtcgcccaatgtcaatatcagttagcaaatatttcttgtcaaaaatgctccctgatgcactagttatgttggaccgaatgttgcgcctcttggctggttacaatatcctcacttgttcagttcgtactcaacaagatggaaagattcagagactttatggtttggctactgttgctaa

SEQ ID NO: 31892 - DNA, 359 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcggcatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31893 - DNA, 359 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31894 - DNA, 361 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31895 - DNA, 362 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31896 - DNA, 248 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttatgttggaccgaatgttgcgtctcttggcttgttacaatatcctcacttgttcagttcgtactcaacaagatggaaaggttcagagactttatggtttggctactgttgctaa

SEQ ID NO: 31897 - DNA, 360 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctgttagaaatcattgctaaagctggacctggtgctcaaatttcacctattgcaattgcttctcagctcccaacaactgatgcaccagttatgttggaccgaattttgcgtctcttggcttgttacaatatcctcacttgttcagttcgtactcaacaagatggaaagattcagagcctttatggtttggctactgttactaa

SEQ ID NO: 31898 - DNA, 360 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggatctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31899 - DNA, 357 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttctcctattgaaattgcttctcagctcccaactgatgcaccagttatgttggaccgaatgttgcgtctcttggcttgttacaatatcctcacttgttcatttcgtactcaacaagatggaaagattcagagcctttatggtttggctactgttgctaa

SEQ ID NO: 31900 - DNA, 353 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31901 - DNA, 357 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31902 - DNA, 355 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttgcaatatcctcacttgttcagttcgtactcaacaagatggaaaggttcagagactttatggtttggctactgttgctaa

SEQ ID NO: 31903 - DNA, 357 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31904 - DNA, 356 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31905 - DNA, 360 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31906 - DNA, 362 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31907 - DNA, 360 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagacggaaagattcagagactttatggtttggctactgttgctaa

SEQ ID NO: 31908 - DNA, 361 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31909 - DNA, 362 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31910 - DNA, 362 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31911 - DNA, 357 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 31912 - DNA, 358 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 31913 - DNA, 358 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31914 - DNA, 349 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctatgtaccagttatgttggaccgaatgttgcgtctcttggcttgttacaatatcctcacttgttcagttcgtactcaacaagatggaaaagttcagagactttatggtttggctactgttgctaa

SEQ ID NO: 31915 - DNA, 356 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 31916 - DNA, 357 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagatactttatggtttggctactgttgctaa

SEQ ID NO: 31917 - DNA, 359 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31918 - DNA, 360 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31919 - DNA, 360 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31920 - DNA, 359 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgcaa

SEQ ID NO: 31921 - DNA, 367 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31922 - DNA, 361 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31923 - DNA, 350 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31924 - DNA, 340 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31925 - DNA, 302 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaatatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31926 - DNA, 325 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggagacggtccagcggcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31927 - DNA, 363 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattgaaattgcttctcagctaccaacaactactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31928 - DNA, 352 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31929 - DNA, 360 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31930 - DNA, 357 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 31931 - DNA, 360 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31932 - DNA, 363 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31933 - DNA, 354 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31934 - DNA, 355 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31935 - DNA, 359 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31936 - DNA, 358 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31937 - DNA, 360 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31938 - DNA, 360 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31939 - DNA, 360 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagattgaaaggttcagagactttatggtttggctactgttgctaa

SEQ ID NO: 31940 - DNA, 360 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31941 - DNA, 362 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31942 - DNA, 359 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31943 - DNA, 394 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaactccagcgcctgcttgccgccatcgtggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31944 - DNA, 365 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31945 - DNA, 359 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31946 - DNA, 359 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacgatgcaccagttatgttggaccgaatgttgcgtctcttggcttgttacaatatcctcacttgttcagttcgtactcaacaagatggaaaggttcagagtctttatggtttggctactgttgctaa

SEQ ID NO: 31947 - DNA, 361 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttgtaccgaatgttgcgtctcttggcttgttacaatatcctcacttgttcagttcgtactcaacaagatggaaaggttcagagactttatggtttggctactgttgctaa

SEQ ID NO: 31948 - DNA, 361 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31949 - DNA, 361 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31950 - DNA, 362 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31951 - DNA, 357 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31952 - DNA, 357 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31953 - DNA, 350 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31954 - DNA, 270 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaccaagatggaaaagttcagagactttatggtgtggctactgttgctaa

SEQ ID NO: 31955 - DNA, 361 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctagtgaaattgcttctcagctcccaacaacctgatgcaccagttatgtcggaccgaatgttgcgtctcttggcttgttacaatatcctcacttgttcagttcgtactcaacaagatggaaaggttcagagactttatggtttggctactgttgctaa

SEQ ID NO: 31956 - DNA, 359 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctcgacctggtgctcaaatttcacctattgaaattgcctctcagctaccaacaattatgcaccagttatgttggaccgaatgttgcgtctcttggcttgttacaatatcctcacttgttcagttcgtactcaacaagatggaaaggttcagagactttatggttgggctactgttgctaa

SEQ ID NO: 31957 - DNA, 360 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagccggacctggtgctcaaagttctcctattgaaattgcgtctcagctcatagcaactaatgcaccagtcatgttggaacgaatgatgcgtcgcttggctcgtaacaataacctcacttgttgacttcgtgctcaacaagatggaaagactcagagactttatagtttcgctactgtgaaaag

SEQ ID NO: 31958 - DNA, 360 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctctcagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31959 - DNA, 359 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaattattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31960 - DNA, 361 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 31961 - DNA, 359 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31962 - DNA, 357 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31963 - DNA, 359 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31964 - DNA, 355 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaagcaccagttatgttggaccgaatgttgcgtctcttggcttgttacaatatcctcacttgttcagttcgtactcaacaagatggaaaggttcagagactttatggtttggctactgttgctaa

SEQ ID NO: 31965 - DNA, 360 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31966 - DNA, 362 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31967 - DNA, 362 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31968 - DNA, 361 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgcttcagtacttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 31969 - DNA, 353 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatgcaactagcaagtgattcagttcttcccatgattttgaaatcagctcctgaacttgatctcttagaaatcatggctaaagctggacctggtgctcaaatttcacctattgaaattgcttctcagcccctgatgcaccagttatgttggaccgaatgttgcgtctcttggcttgttacaatatcctcacttgttcatttcgtactcaacaagatggaaagattcagagactttatggtttggctactgttgctaa

SEQ ID NO: 31970 - DNA, 357 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctaccaacaactgcaccagttatgttggaccgaatgttgcgtctcttggcttgttacaatatcctcacttgttcagttcgtactcaacaagatggaaaggttcagagactttatggtttggctactgttgctaa

SEQ ID NO: 31971 - DNA, 260 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttcgccacgcaactagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactgttgctaa

SEQ ID NO: 31972 - DNA, 354 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaagcaaacctcttagccatgcaactagcaagtgcttcagttcttcccatgattttgaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31973 - DNA, 340 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaaacaaacctcttcgccatgcaattagcaagtgcttcagttcttcccatgattttaaaatcagctcttgaacttgatctcttagaaatcattgctaaagctggacctggtgctcaaatttcacctattgaaattgcttgcaccagttatgttggaccgaatgttgcgtctcttggcttgttacaatatcctcacttgttcagttcgtactcaacaagatggaaaggttcagagactttatggtttggctactgttgctaa

SEQ ID NO: 31974 - DNA, 361 bp, Artificial
  MsCOMT deletion introduced by TALEN pair MsCOMT_T03.1
tctcacaaaaacctcatcaatcacaaacatgggttcaacaggtgaaactcaaataacaccaacccacatatcagatgaagaaacaaacctcttcgccatgcaactagcaagtgcttcagttcttcccaagattttgaaatcagctcttgaacttgatctcttagaaatcattgctaaagctggacctggtgctcaaatttcacctgttcaaattgcttctcagcttccaacaaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 31975 - DNA, 351 bp, Artificial
  MsCOMT deletion introduced by TALEN pair MsCOMT_T03.1
tctcacaaaaacctcatcaatcacaaacatgggttcaacaggtgaaactaaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 31976 - DNA, 359 bp, Artificial
  MsCOMT deletion introduced by TALEN pair MsCOMT_T03.1
tctcacaaaaacctcatcaatcacaaacatgggttcaacaggtgaaactaaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcggagactttatggtttggctactgttgctaa

SEQ ID NO: 31977 - DNA, 440 bp, Artificial
  MsCOMT deletion introduced by TALEN pair MsCOMT_T03.1
tctcacaaaaacctcatcaatcacaaacatgggttcaacaggtgaaactaaaataacaccaacccacatatcagatgaagaagcaaacctcttcgccatgaaattagcaagtgcttcagttcttccaatgattttaaaatcagctcttgaacttgatctcttagaaatcattgataaagctggacctggtgctcaaatttcacctattgaaattgcttctcagctaccaacaactaaccctggaggaggtgaggaggaagttcaacaacggcgagatcaacttcgcggccgactgataactcgagaagggcgcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31978 - DNA, 357 bp, Artificial
  MsCOMT deletion introduced by TALEN pair MsCOMT_T03.1
tctcacaaaaacctcatcaatcacaaacatgggttcaacaggtgaaaatcaaataacaccaacccacatatcagatgaagaagcaaacctcttcgccatgcaactagcaagtgcttcagttcttcccatgattttgaaatcagctcttgaacttgatctcttagaaatcattggtaaagctggacctggtgatcaaatttcacctattgaaattgcttctcagctaccaacagatgcaccagttatgttgtaccgaatgttacgtctcttggcttgttacaatatcctcacttgttcagttcgtactcaacaagagggaaaagttcagagactttatggtttggctactgttgctaa

SEQ ID NO: 31979 - DNA, 357 bp, Artificial
  MsCOMT deletion introduced by TALEN pair MsCOMT_T03.1
tctcacaaaaacctcatcaatcacaaacatgggttcaacaggtgaaaatcaaataacaccaacccacatatcagatgaagaagcaaacctcttagccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatattgcgtctcctggcttgttacagtatccgcacttgttcagttcgtactcaacaagatggaaagattcagagacattatgctttggctactgttactaa

SEQ ID NO: 31980 - DNA, 359 bp, Artificial
  MsCOMT deletion introduced by TALEN pair MsCOMT_T03.1
tctcacaaaaacctcatcaatcacaaacatgggttcaacaggggaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31981 - DNA, 361 bp, Artificial
  MsCOMT deletion introduced by TALEN pair MsCOMT_T03.1
tctcacaaaaacctcatcaatcacaaacatggggtcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctgctgctcaaatttcacatattgacattgcttctcagctaccaacaacctgatgcaccagttatgttggaccgaatattgcgtctcttggcttgttacaatatcctcacttgttcagttcgtactcaacaagatgtaaagattcagagactttatggtttggctactgttgctaa

SEQ ID NO: 31982 - DNA, 355 bp, Artificial
  MsCOMT deletion introduced by TALEN pair MsCOMT_T03.1
tctcacaaaaacctcatcaatcaaaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgatgcaccagttatgttggaccgaatgttgcgtctcttggcttgttacaatatcctcacttgttcagttcgtactcaacaagatgggaagattcagagactttatggtttggctactgttgctaa

SEQ ID NO: 31983 - DNA, 334 bp, Artificial
  MsCOMT deletion introduced by TALEN pair MsCOMT_T03.1
tctcacaaaaacctcatcaatcaaaaaaatgggttcaacaggtgaaaaaaaaagaaaagaaaaacacaaaaaagaggaagaagcaaacctcttcgccatgcaactagcaagtgcttaagttcttcccatgattttgaaatcagctcttgaacttgatctcttagaaatcattgctaaagctggacctggtgctcatctttcacctattgaatgcaccagttatgttggaccgaatgttgcgtctcttggctttttacaatttcctcacttgttcagttcttactcaacaagatggaaattttccactcctttatggtttggctactgttgctaa

SEQ ID NO: 31984 - DNA, 361 bp, Artificial
  MsCOMT deletion introduced by TALEN pair MsCOMT_T03.1
tctcacaaaaacctcatcaataacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgtttgaccgaatgttgcgtctcttggcttgttacaatatcctcacttgttcagttcgtactcaacaagatggaaaggttcagagactttatggtttggctactgttgctaa

SEQ ID NO: 31985 - DNA, 270 bp, Artificial
  MsCOMT deletion introduced by TALEN pair MsCOMT_T03.1
tctcacaaaaacctcatcaataacaaccatgggttcaacaggtgaaactcaaataacaccaacccacatatcagatgaagaagcaaacctcttcgccatgcaactagcaagtgcttcagttcttcccatgattttgacatcagctcttgaacttgatctcttagaaatcattgctaaagctggacctggtgctcaaatttcacctattgaaattgcttctcaacaagatggaaaagttcagagactttatggtttggctactgttgctaa

SEQ ID NO: 31986 - DNA, 359 bp, Artificial
  MsCOMT deletion introduced by TALEN pair MsCOMT_T03.1
tctcacaaaaacctcatcaataacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31987 - DNA, 356 bp, Artificial
  MsCOMT deletion introduced by TALEN pair MsCOMT_T03.1
tctcacaaaaacctcatcaataacaaccatgggttcaacaggtgaaactcaaataacaccaacccacatatcagatgaagaagcaaacctattcgccatgcaactagcaagtgcttcagttcttcccatgatttggaaatcagctcttgaacttgatctcttagaaatcattgctaaagctggacctggtgctcaaatttcgcctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31988 - DNA, 354 bp, Artificial
  MsCOMT deletion introduced by TALEN pair MsCOMT_T03.1
tctcacaaaaacctcatcaataacaaccatgggttcaaaaggtgaaaatcaaataacaccaacccacatatcagttgaagaataaaacctattcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaagtttcagagactttatggtctggctactgttgctaa

SEQ ID NO: 31989 - DNA, 360 bp, Artificial
  MsCOMT deletion introduced by TALEN pair MsCOMT_T03.1
tctcacaaaaacctcatcaagcacaaccatgggttcaacaggggaaactcaaataacaccaacccacatatcagatgaagaagcaaacctcttcgccatgcaactagcaagtgcttcagttcttccaatgattttgaaatcagctcttgaacttgatctcttagaaatcattgctaaagctggacctggtgctcaaatttcccttattgaaattgcttctcagctaccaacaactgatgcaccagttatgttggaccgaatgttgcgtctcttggcttgttacaatatcctcacttgttcagttcgtactcaaccagatggaaaggttcagagactttatggtttggctactgttgctaa

SEQ ID NO: 31990 - DNA, 353 bp, Artificial
  MsCOMT deletion introduced by TALEN pair MsCOMT_T03.1
tctcacaaaaacctcatcaaccacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31991 - DNA, 361 bp, Artificial
  MsCOMT deletion introduced by TALEN pair MsCOMT_T03.1
tctcacaaaaacctcatcaaccacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 31992 - DNA, 260 bp, Artificial
  MsCOMT deletion introduced by TALEN pair MsCOMT_T03.1
tctcacaaaaacctcatcaaccacaaccatgggttcaacaggtgaaactcaaataacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactgttgctaa

SEQ ID NO: 31993 - DNA, 359 bp, Artificial
  MsCOMT deletion introduced by TALEN pair MsCOMT_T03.1
tctcacaaaaacctcatcaaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31994 - DNA, 361 bp, Artificial
  MsCOMT deletion introduced by TALEN pair MsCOMT_T03.1
tctcacaaaaacctcatcaaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31995 - DNA, 356 bp, Artificial
  MsCOMT deletion introduced by TALEN pair MsCOMT_T03.1
tctcacaaaaacctcatcaaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31996 - DNA, 361 bp, Artificial
  MsCOMT deletion introduced by TALEN pair MsCOMT_T03.1
tctcacaaaaacctcatcaaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 31997 - DNA, 363 bp, Artificial
  MsCOMT deletion introduced by TALEN pair MsCOMT_T03.1
tctcacaaaaacctcatcaaacacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctcccaacaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31998 - DNA, 361 bp, Artificial
  MsCOMT deletion introduced by TALEN pair MsCOMT_T03.1
tctcacaaaaacctcatcaaacacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 31999 - DNA, 361 bp, Artificial
  MsCOMT deletion introduced by TALEN pair MsCOMT_T03.1
tctcacaaaaacctcatcaaacacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaattttgcgtctcttggcttgttacaatatcctcacttgttcagttcgtactcaacaagatggaaaggttcagagactttatggtttggctactgttgctaa

SEQ ID NO: 32000 - DNA, 350 bp, Artificial
  MsCOMT deletion introduced by TALEN pair MsCOMT_T03.1
tctcacaaaaacctcataatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 32001 - DNA, 350 bp, Artificial
  MsCOMT deletion introduced by TALEN pair MsCOMT_T03.1
tctcacaaaaacctcataatcacaaccatgggttcaacaggtgaaactccaatcacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaccagttatgttggaccgaatgttgcgtctcttggcttgttacaatatcctcacttgttcagttcgtactcaacaagatggaaagattcagagactttatggtttggctactgttgctaa

SEQ ID NO: 32002 - DNA, 311 bp, Artificial
  MsCOMT deletion introduced by TALEN pair MsCOMT_T03.1
tctcacaaaaacctcataatcacaaccatgggttcaacaggtgaaactccaataacaccaacccacatatcagatgaagaagcaaacctcttcgccatgcaactagcaagtgcttcagttcttcccatgattttgaaatcagctcttgaacttgatctcttagaaatcattgctaaagctggacctggtgcaccagttatgttggaccgaatgttgcgtctcttggcttgttacaatatcctcacttgttcagttcgtactcaacaagatggaaaggttcagagactttatggtttggctactgttgctaa

SEQ ID NO: 32003 - DNA, 356 bp, Artificial
  MsCOMT deletion introduced by TALEN pair MsCOMT_T03.1
tctcacaaaaacctcataatcacaaccatgggttcaacaggtgaaactcaaatcacaccaacccacatatcagatgaggaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32004 - DNA, 434 bp, Artificial
  MsCOMT deletion introduced by TALEN pair MsCOMT_T03.1
tctcacaaaaacctcataatcacaaccatgggttcaacaggtgaaactcaaatcacaccaacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctcccaacaactaacgtaattcaacagaaattatatgataatcatcgcaagaccggcaacaggattcaatcttaagaaactttatttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32005 - DNA, 358 bp, Artificial
  MsCOMT deletion introduced by TALEN pair MsCOMT_T03.1
tctcacaaaaacctcataatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32006 - DNA, 354 bp, Artificial
  MsCOMT deletion introduced by TALEN pair MsCOMT_T03.1
tctcacaaaaacctcataatcacaaccatgggttcaacaggtgaaactcaaataacaccaacccacctatcagatgaagaagcaaacctcttcgccatccaattagcaagagcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaagattcagagactttatggtttggctactggtgctaa

SEQ ID NO: 32007 - DNA, 360 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccattcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32008 - DNA, 360 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtacccaacaagatggaaaagttcagagactttatggtttggctactgttgctaa

SEQ ID NO: 32009 - DNA, 355 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggttctcaaatttcacctattgaaattgcttctcagctaccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32010 - DNA, 349 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32011 - DNA, 234 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgacttgttacaatatcctcacttgttcagttcgtactcaacaagatggaaagattcagagactttatggtttggctactgttgctaa

SEQ ID NO: 32012 - DNA, 248 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggcttgttacaatatcctcacttgttcagttcgtactcaacaagatggaaaggttcagagactttatggtttggctactgttgctaa

SEQ ID NO: 32013 - DNA, 358 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32014 - DNA, 354 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 32015 - DNA, 355 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32016 - DNA, 363 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32017 - DNA, 360 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32018 - DNA, 353 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32019 - DNA, 354 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagtcatgttggaccgaatgttgcgtctcttggcttgttacaatatcctcacttgttctgttcgtactcaacaagatggaaagattcagagactttatggtttggctactgttgctaa

SEQ ID NO: 32020 - DNA, 440 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaggacaggtatccggtaagcggcagggtcggaacaggagagcgcacgagggagcttccagggggaaacgcctggtatctttaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32021 - DNA, 360 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32022 - DNA, 288 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggaccgaatgttgcgtctcttggcttgttacaatatcctcacttgttcagttcgtactcaacaagatggaaaggttcagagactttatggtttggctactgttgctaa

SEQ ID NO: 32023 - DNA, 259 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaattagcaagtgcttcagttcttcccatgattttaaaatcagctctatgttggaccgaatgttgcgtctcttggcttgttacaatatcctcacttgttcagttcgtactcaacaagatggaaaggttcagagactttatggtttggctactgttgctaa

SEQ ID NO: 32024 - DNA, 248 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttggcttgttacaatatcctcacttgttcagttcgtactcaacaagatggaaaggttcagagactttatggtttggctactgttgctaa

SEQ ID NO: 32025 - DNA, 354 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttcagttcgtactcaacaagatggaaaagttcagagactttatggtttggctactgttgctaa

SEQ ID NO: 32026 - DNA, 358 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 32027 - DNA, 350 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagcttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32028 - DNA, 360 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacccgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32029 - DNA, 359 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32030 - DNA, 360 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32031 - DNA, 360 bp, Artificial
  MsCOMT deletion introduced by TALEN pair MsCOMT_T03.1
tctcacaaaaacctcataatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctgttcaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32032 - DNA, 344 bp, Artificial
  MsCOMT deletion introduced by TALEN pair MsCOMT_T03.1
tctcacaaaaacctcataatcacaaccatgggctcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgttggaccgaatgttgcgtctcttggcttgttacaatatcctcacttgttcagttcgtactcaacaagatggaaaggttcagagactttatggtttggctactgttgctaa

SEQ ID NO: 32033 - DNA, 365 bp, Artificial
  MsCOMT deletion introduced by TALEN pair MsCOMT_T03.1
tctcacaaaaacctcataaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32034 - DNA, 362 bp, Artificial
  MsCOMT deletion introduced by TALEN pair MsCOMT_T03.1
tctcacaaaaacctcagcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaacctgatgcaccagttatgttggaccgaatgttgcgtctcttggcgtgggacaagatcctcactggggaagggcggactcaacaagatggaaaagttcagagactttatggtttggctactgttgctac

SEQ ID NO: 32035 - DNA, 361 bp, Artificial
  MsCOMT deletion introduced by TALEN pair MsCOMT_T03.1
tctcacaaaaacctcagcaatcacaaccatgggttcaacaggtgaaactcaaataacaccaacccacatatcagatgaagaagcaaacctcttcgccatgaaattagcaagtgcttcagttcttccaatgattttaaaatcagctcttgaacttgatctcttagaaatcattgctaaagctggacctggtgctcaaatttcacctattgaaattgcttctcagctcccaacaacctgattcaccagttatgttggaccgaatgttgcgtctcttggcgtgggacaagatcctcactggggaagggcggactcaacaagatggaaagattcagagactttatcgtttggctactgttgctaa

SEQ ID NO: 32036 - DNA, 207 bp, Artificial
  MsCOMT deletion introduced by TALEN pair MsCOMT_T03.1
tctcacaaaaacctcaccaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctacaagatggaaagattcagagactttatggtttggctactgttgctaa

SEQ ID NO: 32037 - DNA, 356 bp, Artificial
  MsCOMT deletion introduced by TALEN pair MsCOMT_T03.1
tctcacaaaaacctcaccaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32038 - DNA, 360 bp, Artificial
  MsCOMT deletion introduced by TALEN pair MsCOMT_T03.1
tctcacaaaaacctcaccaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagtccgtactcaacaagatggaaaggttcagagactttatggtttggctactgttgctaa

SEQ ID NO: 32039 - DNA, 354 bp, Artificial
  MsCOMT deletion introduced by TALEN pair MsCOMT_T03.1
tctcacaaaaacctcaccaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccctatgcaccagttatgttggaccgaatgttgcgtctcttggcttgttacaatatcctcacttgttcagttcgtactcaacaagatggaaaggttcagagactttattgtttggctactgttgctaa

SEQ ID NO: 32040 - DNA, 358 bp, Artificial
  MsCOMT deletion introduced by TALEN pair MsCOMT_T03.1
tctcacaaaaacctcaccaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32041 - DNA, 359 bp, Artificial
  MsCOMT deletion introduced by TALEN pair MsCOMT_T03.1
tctcacaaaaacctcaccaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32042 - DNA, 293 bp, Artificial
  MsCOMT deletion introduced by TALEN pair MsCOMT_T03.1
tctcacaaaaacctcacaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttagaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32043 - DNA, 313 bp, Artificial
  MsCOMT deletion introduced by TALEN pair MsCOMT_T03.1
tctcacaaaaacctcacaatcacaaccatgggttcaacaggtgaaactccaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaccagttatgttggaccgaatgttgcgtctcttggcttgttacaatatcctcacttgttcagttcgtactcaacaagatggaaaggttcagagactttatggtttggctactgttgctaa

SEQ ID NO: 32044 - DNA, 328 bp, Artificial
  MsCOMT deletion introduced by TALEN pair MsCOMT_T03.1
tctcacaaaaacctcacaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagaccgaatgttgcgtctcttggcttgttacaatatcctcacttgttcagttcgtactcaacaagatggaaagattcagagactttatggtttggctactgttgctaa

SEQ ID NO: 32045 - DNA, 340 bp, Artificial
  MsCOMT deletion introduced by TALEN pair MsCOMT_T03.1
tctcacaaaaacctcacaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32046 - DNA, 356 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaattagtaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32047 - DNA, 361 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtactcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32048 - DNA, 312 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcactgtcaccgaatgttgcgtctcttggcttgttacaatatcctcacttgttctgttcgtactcaacaagatggaaaggttcagagactttatggtttggctactgttgctaa

SEQ ID NO: 32049 - DNA, 354 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32050 - DNA, 356 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32051 - DNA, 359 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32052 - DNA, 359 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32053 - DNA, 361 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32054 - DNA, 360 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggataatgttgctaa

SEQ ID NO: 32055 - DNA, 355 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32056 - DNA, 357 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32057 - DNA, 414 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacgccattatctccgacgcactgaaccacgcgtctattattgatggtgtgcgctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32058 - DNA, 320 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcaccagtcatgttggaccgaatgttgcgtctcttggcttgttacaatatcctcacttgttcagttcgtactcaacaagatggaaagattcagagactttatggtttggctactgttgctaa

SEQ ID NO: 32059 - DNA, 343 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatgttggaccgaatgttgcgtctcttggcttgttacaatatcctcacttgttctgttcgtactcaacaagatggaaaggttcagagactttatggtttggctactgttgctaa

SEQ ID NO: 32060 - DNA, 360 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32061 - DNA, 352 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32062 - DNA, 359 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32063 - DNA, 360 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32064 - DNA, 288 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctagaccgaatgttgcgtctcttggcttgttacaatatcctcacttgttcagttcgtactcaacaagatggaaaggttcagagactttatggtttggctactgttgctaa

SEQ ID NO: 32065 - DNA, 360 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32066 - DNA, 353 bp, Artificial
  MsCOMT deletion introduced by TALEN pair MsCOMT_T03.1
tctcacaaaaacctcacaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtctcaacaagatggaaaggttcagagactttatggtttggctactgttgctaa

SEQ ID NO: 32067 - DNA, 366 bp, Artificial
  MsCOMT deletion introduced by TALEN pair MsCOMT_T03.1
tctcacaaaaacctcaatcaatcacaaccatgggttcaacaggtgaaactcaaataacaccaacccacatatcagatgaagacgcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32068 - DNA, 362 bp, Artificial
  MsCOMT deletion introduced by TALEN pair MsCOMT_T03.1
tctcacaaaaacctcaatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32069 - DNA, 362 bp, Artificial
  MsCOMT deletion introduced by TALEN pair MsCOMT_T03.1
tctcacaaaaacctcaacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32070 - DNA, 361 bp, Artificial
  MsCOMT deletion introduced by TALEN pair MsCOMT_T03.1
tctcacaaaaacctatcaatcacaaccatgggttcaacaggtgaaactccaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32071 - DNA, 357 bp, Artificial
  MsCOMT deletion introduced by TALEN pair MsCOMT_T03.1
tctcacaaaaacctatcaatcacaaccatgggttcaacaggtgaaactcaaatcacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32072 - DNA, 356 bp, Artificial
  MsCOMT deletion introduced by TALEN pair MsCOMT_T03.1
tctcacaaaaacctatcaatcacaaccatgggttcaacaggtgaaactcaaatcacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 32073 - DNA, 360 bp, Artificial
  MsCOMT deletion introduced by TALEN pair MsCOMT_T03.1
tctcacaaaaacctatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcatctattgtaattgcttctcagctaccatcaacctgatgcaccagttatgttggaccgaatgtggcgtctcttgtcttgttacaatatcctcacttgttcagttcgtactcaacaagatggaaaggttcagagactttatagtttggctactgttgctaa

SEQ ID NO: 32074 - DNA, 357 bp, Artificial
  MsCOMT deletion introduced by TALEN pair MsCOMT_T03.1
tctcacaaaaacctatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32075 - DNA, 361 bp, Artificial
  MsCOMT deletion introduced by TALEN pair MsCOMT_T03.1
tctcacaaaaacctatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32076 - DNA, 355 bp, Artificial
  MsCOMT deletion introduced by TALEN pair MsCOMT_T03.1
tctcacaaaaacctatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32077 - DNA, 361 bp, Artificial
  MsCOMT deletion introduced by TALEN pair MsCOMT_T03.1
tctcacaaaaacctatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtacttaacaagatggaaaggttcagagactttatggtttggctactgttgctaa

SEQ ID NO: 32078 - DNA, 358 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtcacttggcttgttacaatatcctcacttgttcagttcgtactcaacaagatggaaagattcagagcctttatggtttggctactgttgctaa

SEQ ID NO: 32079 - DNA, 266 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctggaccgaatgttgcgtctcttggcttgttacaatatcctcacttgttcagttcgtactcaacaagatggaaaggttcagagactttatggtttggctactgttgctaa

SEQ ID NO: 32080 - DNA, 360 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32081 - DNA, 351 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32082 - DNA, 359 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32083 - DNA, 361 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32084 - DNA, 234 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgacttgttacaatatcctcacttgttcagttcgtactcaacaagatggaaagattcagagactttatggtttggctactgttgctaa

SEQ ID NO: 32085 - DNA, 336 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32086 - DNA, 349 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32087 - DNA, 357 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32088 - DNA, 354 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 32089 - DNA, 354 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttctgttcgtactcaacaagatggaaaggttcagagactttatggtttggctactgttgctaa

SEQ ID NO: 32090 - DNA, 404 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagactgggcctttcgttttatctgttgtttgtcggtgaacgctctccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32091 - DNA, 364 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32092 - DNA, 359 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 32093 - DNA, 395 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccggcaacagccgctggaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32094 - DNA, 357 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32095 - DNA, 299 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcatcctcacttgttcagttcgtactcaacaagatggaaagattcagagactttatggtttggctactgttgctaa

SEQ ID NO: 32096 - DNA, 359 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32097 - DNA, 356 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32098 - DNA, 358 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32099 - DNA, 359 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32100 - DNA, 360 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32101 - DNA, 360 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctgttcaaattgcttctcagcttccaacaacctgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 32102 - DNA, 360 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaattagcaagtgcttcagttcttcccatgattttaaaaccagctcttgaacttgatctcttagaaatcattgctaaagctggacctggtgctcaaatttcacctattgaaattgcttctcagctcccaacaaactgatgcaccagtcatgttggaccgaatgttgcgtctcttggcttgttaaaatatcctcacttgttcagttcgtactcaacaagatgtaaacgttcagagactttatggtttggctactgttgctaa

SEQ ID NO: 32103 - DNA, 234 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgacttgttacaatatcctcacttgttcagttcgtactcaacaagatggaaagattcagagactttatggtttggctactgttgctaa

SEQ ID NO: 32104 - DNA, 391 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacaacttagctcattaaactccagaaacccgcggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32105 - DNA, 359 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32106 - DNA, 351 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaattatgttggaccgaatgttgcgtctcttggcttgttacaatatcctcacttgttcagttcgtactcaacaagatggaaagattcagagactttatggtttggctactgttgctaa

SEQ ID NO: 32107 - DNA, 356 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32108 - DNA, 355 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32109 - DNA, 350 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 32110 - DNA, 358 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32111 - DNA, 359 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32112 - DNA, 359 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32113 - DNA, 364 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 32114 - DNA, 360 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32115 - DNA, 269 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaacaagatggaaaagttcagagactttatggtttggctactgttgctaa

SEQ ID NO: 32116 - DNA, 298 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctgagttatgttggaccgaatgttgcgtctcttggcttgttacaatatcctcacttgttcagttcgtactcaacaagatggaaaggttcagagactttatggtttggctactgttgctaa

SEQ ID NO: 32117 - DNA, 364 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacatgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32118 - DNA, 360 bp, Artificial
  MsCOMT deletion introduced by TALEN pair MsCOMT_T03.1
tctcacaaaaacctatcaatcacaaccatgggttcaacaggtgaaactcaaataacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32119 - DNA, 359 bp, Artificial
  MsCOMT deletion introduced by TALEN pair MsCOMT_T03.1
tctcacaaaaacctatcaatcacaacaatgggttcaacaggtgaaactcaaataacaccaacacacatatcagatgaagaagaaaacctcttcgccatgcaactaacaagttcttcagttcttcccatgattttgaaatcagctcttgaacttaatctcttagaaatcattgctaaagctggaccttgtgctcaaatttcacctattgatattgcttctcagctcccaaccactgattcaccagttatgttggaccgaatgttgcgtctcttggcttgttacaatatcctcacttgttcagttcgtactcaacaagatggaaaggttcagagactttatggtttggctactgttgctaa

SEQ ID NO: 32120 - DNA, 361 bp, Artificial
  MsCOMT deletion introduced by TALEN pair MsCOMT_T03.1
tctcacaaaaacctaatcaatcacaaccatgggctcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32121 - DNA, 345 bp, Artificial
  MsCOMT deletion introduced by TALEN pair MsCOMT_T03.1
tctcacaaaaaccgcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttcagttcgtactcaacaagatggaaaggttcagagactttatggtttggctactgttgctaa

SEQ ID NO: 32122 - DNA, 365 bp, Artificial
  MsCOMT deletion introduced by TALEN pair MsCOMT_T03.1
tctcacaaaaaccctcatcaatcacaaccatgggttcaacaggtgaaactcaactaacaccaacccacatatcagatgaagaagcaaacctcttcgccatacaactagcaagtgcttcagttcttcccatgattttgaaatcagctcttgaacttgatctcttagaaatcattgctaaagctggacctggtgctcaaatttcacctattgaaattgcttctcagctaccaacaactccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32123 - DNA, 359 bp, Artificial
  MsCOMT deletion introduced by TALEN pair MsCOMT_T03.1
tctcacaaaaaccctcatcaatcacaaccatgggttcaacaggtgaaactcaaataacaccaacccacatatcagatgaagacgcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32124 - DNA, 362 bp, Artificial
  MsCOMT deletion introduced by TALEN pair MsCOMT_T03.1
tctcacaaaaaccctcatcaatcacaaccatgggttcaacaggtgaaactcaaataacaccaacccacatatcagatgaagacgcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32125 - DNA, 357 bp, Artificial
  MsCOMT deletion introduced by TALEN pair MsCOMT_T03.1
tctcacaaaaacccctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacaccagttatgttggaccgaatgttgcgtctcttggcttgttacaatatcctcacttgttcagttcgtactcaacaagatggaaaggttcagagactttatggtttggctactgttgctaa

SEQ ID NO: 32126 - DNA, 361 bp, Artificial
  MsCOMT deletion introduced by TALEN pair MsCOMT_T03.1
tctcacaaaaaccccatcaatcacaaccatgggttcaacaggtgaaactcaaataacaccaacccacatatcagatgaagaagcaaacctcttcgccatgcaactagcaagtgcttcagttcttcccatgatttttaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32127 - DNA, 360 bp, Artificial
  MsCOMT deletion introduced by TALEN pair MsCOMT_T03.1
tctcacaaaaaccccatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggatctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32128 - DNA, 361 bp, Artificial
  MsCOMT deletion introduced by TALEN pair MsCOMT_T03.1
tctcacaaaaaccccatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32129 - DNA, 328 bp, Artificial
  MsCOMT deletion introduced by TALEN pair MsCOMT_T03.1
tctcacaaaaacccatcaatcacaaccattggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttcttggaccgaatgttgcgtctcttggcttgttacaatatcctcacttgttcagttcgtactcaacaagatggaaaagttcagagactttatggtttggctactgttgctaa

SEQ ID NO: 32130 - DNA, 351 bp, Artificial
  MsCOMT deletion introduced by TALEN pair MsCOMT_T03.1
tctcacaaaaacccatcaatcacaaccatgggttcaacaggtgaaactcaaatcacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32131 - DNA, 360 bp, Artificial
  MsCOMT deletion introduced by TALEN pair MsCOMT_T03.1
tctcacaaaaacccatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32132 - DNA, 415 bp, Artificial
  MsCOMT deletion introduced by TALEN pair MsCOMT_T03.1
tctcacaaaaacccatcaatcacaaccatgggttcaacaggtgaaactcaaataacaccaacccacatatcagatgacgaagcaaacctcttcgccatgcaattagcaagtgcttcagttcttcccatgattttaaattcagctcttgaacttgatctcttagcaatcattgctaaagctggacctggtgctcaaatttcacctattgaaattgcttctcagctcccaacaactaaccgagcaggtggtggccatcgccagccacgatggcggcaagcaggcgctggactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32133 - DNA, 355 bp, Artificial
  MsCOMT deletion introduced by TALEN pair MsCOMT_T03.1
tctcacaaaaacccatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32134 - DNA, 354 bp, Artificial
  MsCOMT deletion introduced by TALEN pair MsCOMT_T03.1
tctcacaaaaacccatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32135 - DNA, 357 bp, Artificial
  MsCOMT deletion introduced by TALEN pair MsCOMT_T03.1
tctcacaaaaacccatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32136 - DNA, 359 bp, Artificial
  MsCOMT deletion introduced by TALEN pair MsCOMT_T03.1
tctcacaaaaacccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32137 - DNA, 357 bp, Artificial
  MsCOMT deletion introduced by TALEN pair MsCOMT_T03.1
tctcacaaaaacccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32138 - DNA, 464 bp, Artificial
  MsCOMT deletion introduced by TALEN pair MsCOMT_T03.1
tctcacaaaaacccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaagcaacaatgctctccagcgacggcctgccgccgccatggctggcgatggccaccacctgctgaggggtcaagccgtgggcctggcacagcaccggcaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32139 - DNA, 299 bp, Artificial
  MsCOMT deletion introduced by TALEN pair MsCOMT_T03.1
tctcacaaaaacccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcatcctcacttgttcagttcgtactcaacaagatggaaagattcagagactttatggtttggctactgttgctaa

SEQ ID NO: 32140 - DNA, 354 bp, Artificial
  MsCOMT deletion introduced by TALEN pair MsCOMT_T03.1
tctcacaaaaacccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaagatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32141 - DNA, 354 bp, Artificial
  MsCOMT deletion introduced by TALEN pair MsCOMT_T03.1
tctcacaaaaacccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32142 - DNA, 354 bp, Artificial
  MsCOMT deletion introduced by TALEN pair MsCOMT_T03.1
tctcacaaaaacccatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 32143 - DNA, 359 bp, Artificial
  MsCOMT deletion introduced by TALEN pair MsCOMT_T03.1
tctcacaaaaacccatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32144 - DNA, 360 bp, Artificial
  MsCOMT deletion introduced by TALEN pair MsCOMT_T03.1
tctcacaaaaacccatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32145 - DNA, 361 bp, Artificial
  MsCOMT deletion introduced by TALEN pair MsCOMT_T03.1
tctcacaaaaacccatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32146 - DNA, 356 bp, Artificial
  MsCOMT deletion introduced by TALEN pair MsCOMT_T03.1
tctcacaaaaacccaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32147 - DNA, 359 bp, Artificial
  MsCOMT deletion introduced by TALEN pair MsCOMT_T03.1
tctcacaaaaaccatcaatcacaaccatgggttcaacaggtgaaactcaaataccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32148 - DNA, 360 bp, Artificial
  MsCOMT deletion introduced by TALEN pair MsCOMT_T03.1
tctcacaaaaaccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32149 - DNA, 294 bp, Artificial
  MsCOMT deletion introduced by TALEN pair MsCOMT_T03.1
tctcacaaaaaccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgttacaatatcctcacttgttcagttcgtactcaacaagatggaaaagttcagagactttatggtttggctactgttgctaa

SEQ ID NO: 32150 - DNA, 355 bp, Artificial
  MsCOMT deletion introduced by TALEN pair MsCOMT_T03.1
tctcacaaaaaccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32151 - DNA, 356 bp, Artificial
  MsCOMT deletion introduced by TALEN pair MsCOMT_T03.1
tctcacaaaaaccatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32152 - DNA, 365 bp, Artificial
  MsCOMT deletion introduced by TALEN pair MsCOMT_T03.1
tctcacaaaaaccatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32153 - DNA, 360 bp, Artificial
  MsCOMT deletion introduced by TALEN pair MsCOMT_T03.1
tctcacaaaaaccacatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32154 - DNA, 356 bp, Artificial
  MsCOMT deletion introduced by TALEN pair MsCOMT_T03.1
tctcacaaaaacatcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggactgaatgttgcgtctcttggcttgttacaatatcctcacttgttcagttcgtactcaacaagatggaaaggttcagagactttatggtttggctactgttgctaa

SEQ ID NO: 32155 - DNA, 354 bp, Artificial
  MsCOMT deletion introduced by TALEN pair MsCOMT_T03.1
tctcacaaaaacatcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacaccagttatgttggaccgaatgttgcgtctcttggcttgttacaatatcctcacttgttcagttcgtactcaacaagatggaaaggttcagagactttatggtttggctactgttgctaa

SEQ ID NO: 32156 - DNA, 350 bp, Artificial
  MsCOMT deletion introduced by TALEN pair MsCOMT_T03.1
tctcacaaaaacatcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaatgcaccagttatgttggaccgaatgttgcgtctcttggcttgttacaatatcctcacttgttcagttcgtactcaacaatatggaaaggttcagagactttatggtttggctactgttgctaa

SEQ ID NO: 32157 - DNA, 356 bp, Artificial
  MsCOMT deletion introduced by TALEN pair MsCOMT_T03.1
tctcacaaaaaactcattaatcacaaccatgggttcaacaggtgaaactcaaataacaccaacccacatatcagatgaagaagcaaacctcttctccatgcaattagcaagtgcttcagttcttcccatgattttgaaatcagctcttgaacttgatctcttagaaatcattgctaaagctggacctggtgctcaaatttcacctattgaaattgcttctcagctcccaacaactaaccagttatgttggaccgaatgttgcgtctcttggcttgttacaatatcctcacttgttcagttcgtactcaacaagatggaaaggttcagagactttatggtttggctactgttgctaa

SEQ ID NO: 32158 - DNA, 360 bp, Artificial
  MsCOMT deletion introduced by TALEN pair MsCOMT_T03.1
tctcacaaaaaactcatcaatcacaaccatgggttcaacgggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32159 - DNA, 360 bp, Artificial
  MsCOMT deletion introduced by TALEN pair MsCOMT_T03.1
tctcacaaaaaactcatcaatcacaaccatgggttcaacaggtgaactcaaataacaccaacccacatatcagatgaagaagcaaacctcttcgccatgcaactagcaagtgcttcagttcttcccatgattttaaaatcagctcttgaacttgctctcttagaaatcattgctaaagctggacctggtgctcaaatttcacctgttcaaattgcttctcagcttccaacaagctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32160 - DNA, 370 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaatcctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaaccaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32161 - DNA, 360 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32162 - DNA, 358 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttctcatgattttaaaatcagctcttgaacttgatctcttagaaatcattgctaaagctggacctggtgcacaaatttcacctattgaaattgcttctcagctcccaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32163 - DNA, 360 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32164 - DNA, 363 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32165 - DNA, 360 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagcttttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcccttgttcagttcgtactcaacaagatggaaagattcagagactttatggtttggctactgttgctaa

SEQ ID NO: 32166 - DNA, 361 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgctctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtacgcaacaagatggaaaggttcagagactttatggtttggctactgtggctaa

SEQ ID NO: 32167 - DNA, 361 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctgtaccttgtgctcaaatttcacctattgaaattgcttctcagctaccaacatcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32168 - DNA, 361 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcatatttcacctattgaaattgcttctcagctcccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32169 - DNA, 357 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaactgatgcaccagtcatgttggaccgaatgttgcgtctcttggcttgttacaatatcctcacttgttcagttcgtactcaacaagatggaaagattcagagactttatggtttggctactgttgctaa

SEQ ID NO: 32170 - DNA, 359 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 32171 - DNA, 360 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 32172 - DNA, 355 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32173 - DNA, 357 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32174 - DNA, 358 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32175 - DNA, 353 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacgcaccagttatgttggaccgaatgttgcgtctcttggcttgttacaatatcctcacttgttcagttcgtactcaacaagatggaaagattcagagactttatggtttggctactgttgctaa

SEQ ID NO: 32176 - DNA, 358 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32177 - DNA, 343 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagttggaccgaatgttgcgtctcttggcttgttacaatatcctcacttgttcagttcgtactcaacaagatggaaaggttcagagactttatggtttggctactgttgctaa

SEQ ID NO: 32178 - DNA, 356 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32179 - DNA, 358 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32180 - DNA, 363 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32181 - DNA, 277 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatggaaagattcagagactttatggtttggctactgttgctaa

SEQ ID NO: 32182 - DNA, 360 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32183 - DNA, 348 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgttggaccgaatgttgcgtctcttggcttgttacaatatcctcacttgttcagttcgtactcaacaagatggaaagattcagagactttatggtttggctactgttgctaa

SEQ ID NO: 32184 - DNA, 435 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactggcgatggccaccgccggctccggggtcaagccgtgggcctggcacagcaccggcaacaggcgctggaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32185 - DNA, 361 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32186 - DNA, 361 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32187 - DNA, 362 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttggtacaatatccgcacttgttcagttcgtactcaacaagatggaaaggttcagagactttatggtttggctactgttgctaa

SEQ ID NO: 32188 - DNA, 355 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 32189 - DNA, 357 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgtttcaatatcctcacttgttcagttcgtactcaacaagatggaaaggttcagagactttatggtttggctactgttgctaa

SEQ ID NO: 32190 - DNA, 359 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32191 - DNA, 361 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32192 - DNA, 360 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32193 - DNA, 362 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32194 - DNA, 365 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32195 - DNA, 388 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaagccagttaccttcggaaaaagagtctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32196 - DNA, 361 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32197 - DNA, 363 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32198 - DNA, 341 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaaggttcagagactttatggtttggctactgttgctaa

SEQ ID NO: 32199 - DNA, 302 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 32200 - DNA, 358 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctccaatttcacctattgaaattgcttctcagctaccaacaagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32201 - DNA, 359 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 32202 - DNA, 360 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32203 - DNA, 358 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaagatgcaccagttatgttggaccgaatattgcgtctcttggcttgttacaatatcctcacttgttcagttcgtactcaacaagatggaaagattcagagactttatggtttggctactgttgctaa

SEQ ID NO: 32204 - DNA, 362 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaaccctgatgcaccagttatgttggaccgaatgtcgcgtctcttggcttgttacaatatcctcacttgttcagttcgtactcaacaagatggaaagattcagagactttatggtttggctactgttgctaa

SEQ ID NO: 32205 - DNA, 364 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacatcctgatgcaccagttatgttgtaacgaatgttgcgtctctatgcttgttacaatatcctcccttgttcagttcgtactcaacaagatggaaaggttcagagactttatggtttggctactgttgctaa

SEQ ID NO: 32206 - DNA, 330 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaatgttgcgtctcttggcttgttacaatatcctcacttgttcagttcgtactcaacaagatggaaaagttcagagactttatggtttggctactgttgctaa

SEQ ID NO: 32207 - DNA, 359 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32208 - DNA, 359 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggatactgttgctaa

SEQ ID NO: 32209 - DNA, 356 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32210 - DNA, 359 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32211 - DNA, 359 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcatactcaacaagatggaaaggttcagagactttatggtttggctactgttgctaa

SEQ ID NO: 32212 - DNA, 349 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaggttcagagactttatggtttggctactgttgctaa

SEQ ID NO: 32213 - DNA, 360 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32214 - DNA, 360 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32215 - DNA, 360 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32216 - DNA, 362 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32217 - DNA, 389 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactagcgtgaccgagttcaagttcctgttcgtgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32218 - DNA, 361 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32219 - DNA, 362 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32220 - DNA, 351 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacagttatgttggaccgaatgttgcgtctcttggcttgttacaatatcctcacttgttcagttcgtactcaacaagatggaaaagttcagagactttatggtttggctactgttgctaa

SEQ ID NO: 32221 - DNA, 363 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32222 - DNA, 331 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaaccagttatgttggaccgaatgttgcgtctcttggcttgttacaatatcctcacttgttcagttcgtactcaacaagatggaaaggttcagagactttatggtttggctactgttgctaa

SEQ ID NO: 32223 - DNA, 207 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctacaagatggaaagattcagagactttatggtttggctactgttgctaa

SEQ ID NO: 32224 - DNA, 357 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32225 - DNA, 341 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaacctcttcgccatgcaactagcaagtgctgcagttcttcccatgattttaaaatcagctcttgaacttgatctcttagaaatcattgctaaagctggacctggtgctcaaatttcacctattgaaattctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32226 - DNA, 362 bp, Artificial
  MsCOMT deletion introduced by TALEN pair MsCOMT_T03.1
tctcacaaaaaactcatcaatcacaaccatgggttcaacaggtgaaactcaaataacaccaacccacatatcagatgaagaagcaaaactcttcgccatgcaactagcaagtgcttaagttcttcccatgattttgaaatcagctcttgaacttgatctcttagaaatcattgctaaagctggacctggtgctcaaatttcacctattgaaattgcatctcagctcccaacaaccctgatgcaccagttatgttggaacgtatgttgagtcgcttggcttgttacaatatcctaacttgttcatttcgtgcccaacaagatggaaaagttcagagactttatggtttggctactggtgctaa

SEQ ID NO: 32227 - DNA, 355 bp, Artificial
  MsCOMT deletion introduced by TALEN pair MsCOMT_T03.1
tctcacaaaaaactcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaccagtcatgttggaccgaatgttgcgtctcttggcttgttacaatatcctcacttgttctgttcgtactcaacaagatggacaggttcagagactttatggtttggctactgttgctaa

SEQ ID NO: 32228 - DNA, 360 bp, Artificial
  MsCOMT deletion introduced by TALEN pair MsCOMT_T03.1
tctcacaaaaaactcatcaatcacaaccatgggttcaacaggggaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 32229 - DNA, 360 bp, Artificial
  MsCOMT deletion introduced by TALEN pair MsCOMT_T03.1
tctcacaaaaaactcatcaatcacaaacatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcatttcgtactcaacaagatggaaagattcagagactttatggtttggctactgttgctaa

SEQ ID NO: 32230 - DNA, 354 bp, Artificial
  MsCOMT deletion introduced by TALEN pair MsCOMT_T03.1
tctcacaaaaaactcatcaatcaaccatgggttcaacaggtgcaactcaaataccaccaacccacatatcagatgaagaagcaaacctcttcgccatgcaactagcaagtgcttcagttcttcccatgattttaaaatcagctcttgaacttgatctcttagaaatcattactaaagctggacctggtgctcaaatttcacctattgaaattgcttctcatctaccaccaatgcaccagttatgttggaccgaatgttgcgtctcttggattgttacaatatcctcacttgttcagttcgtactcaacaagatggaaaagttcagagcctttatggtttggctactgttgctaa

SEQ ID NO: 32231 - DNA, 362 bp, Artificial
  MsCOMT deletion introduced by TALEN pair MsCOMT_T03.1
tctcacaaaaaaccttcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32232 - DNA, 311 bp, Artificial
  MsCOMT deletion introduced by TALEN pair MsCOMT_T03.1
tctcacaaaaaacctcatcaatcacaaccatgggttcaacaggtgaaactcaaataataccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcgtctcttggcttgttacaatatcctcacttgttcagttcgtactcaacaagatggaaaggttcagagactttatggtttggctactgttgctaa

SEQ ID NO: 32233 - DNA, 360 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagacgcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32234 - DNA, 361 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagacgcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32235 - DNA, 360 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagacgcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaagattcagagactttatggtttggctactgttgctaa

SEQ ID NO: 32236 - DNA, 363 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagaagcaaacctcttcgccatgcaattagcaattgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32237 - DNA, 361 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 32238 - DNA, 361 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32239 - DNA, 362 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32240 - DNA, 355 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagcttcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32241 - DNA, 360 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32242 - DNA, 361 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32243 - DNA, 362 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32244 - DNA, 363 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32245 - DNA, 362 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32246 - DNA, 357 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 32247 - DNA, 360 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32248 - DNA, 361 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32249 - DNA, 358 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32250 - DNA, 208 bp, Artificial
  MsCOMT deletion introduced by TALEN pair MsCOMT_T03.1
tctcacaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctacaagatggaaagattcagagactttatggtttggctactgttgctaa

SEQ ID NO: 32251 - DNA, 358 bp, Artificial
  MsCOMT deletion introduced by TALEN pair MsCOMT_T03.1
tctcaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32252 - DNA, 363 bp, Artificial
  MsCOMT deletion introduced by TALEN pair MsCOMT_T03.1
tctcaacaaaaacctcatcaatcacaaccatgggttcaacaggtgaaactcaaataacaccaacccacatatcagatgaagacgcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32253 - DNA, 346 bp, Artificial
  MsCOMT deletion introduced by TALEN pair MsCOMT_T03.1
tctcaacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttcagttcgtactcaacaagatggaaaggttcagagactttatggtttggctactgttgctaa

SEQ ID NO: 32254 - DNA, 358 bp, Artificial
  MsCOMT deletion introduced by TALEN pair MsCOMT_T03.1
tctcaacaaaaacctcacaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32255 - DNA, 356 bp, Artificial
  MsCOMT deletion introduced by TALEN pair MsCOMT_T03.1
tctcaaacctcatcaatcacaaccatgggttcaacaggtgaacctcaaataactccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32256 - DNA, 409 bp, Artificial
  MsCOMT deletion introduced by TALEN pair MsCOMT_T03.1
tctcaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaagtcaagccgtgggcctggcacagcaccggcaacagccgctggaccgtctccagcgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32257 - DNA, 352 bp, Artificial
  MsCOMT deletion introduced by TALEN pair MsCOMT_T03.1
tctcaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32258 - DNA, 306 bp, Artificial
  MsCOMT deletion introduced by TALEN pair MsCOMT_T03.1
tctcaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctgcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32259 - DNA, 351 bp, Artificial
  MsCOMT deletion introduced by TALEN pair MsCOMT_T03.1
tctcaaaacctcatcaatcacaaccatgggttcaacaggtgaaactcaaataacaccaacccacatatcagatgaagaagcacacctcttcgccatgcaactagcaagtgcttcagttcttcccatgatttgaaatcagctcttgaacttgatctcttagaaatcattgctaaagctggacctggtgctcaaatttcacctattgaaattgcttctcagctaccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32260 - DNA, 357 bp, Artificial
  MsCOMT deletion introduced by TALEN pair MsCOMT_T03.1
tctcaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32261 - DNA, 359 bp, Artificial
  MsCOMT deletion introduced by TALEN pair MsCOMT_T03.1
tctcaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32262 - DNA, 357 bp, Artificial
  MsCOMT deletion introduced by TALEN pair MsCOMT_T03.1
tctcaaaacctcatcaatcacaaccatggggtcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgcaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32263 - DNA, 356 bp, Artificial
  MsCOMT deletion introduced by TALEN pair MsCOMT_T03.1
tctcaaaacctcatcaaacacaaccatgggttcaacaggtgacactcaaataacaccaacccacatatcagatgaagaagcacacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32264 - DNA, 357 bp, Artificial
  MsCOMT deletion introduced by TALEN pair MsCOMT_T03.1
tctcaaaaacctcatcaatcacaaccatgggttcaacaggtgaaactcaaataacaccaacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttgctactgttgctaa

SEQ ID NO: 32265 - DNA, 233 bp, Artificial
  MsCOMT deletion introduced by TALEN pair MsCOMT_T03.1
tctcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgacttgttacaatatcctcacttgttcagttcgtactcaacaagatggaaagattcagagactttatggtttggctactgttgctaa

SEQ ID NO: 32266 - DNA, 247 bp, Artificial
  MsCOMT deletion introduced by TALEN pair MsCOMT_T03.1
tctcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttggcttgttacaatatcctcacttgttcagttcgtactcaacaagatggaaaggttcagagactttatggtttggctactgttgctaa

SEQ ID NO: 32267 - DNA, 359 bp, Artificial
  MsCOMT deletion introduced by TALEN pair MsCOMT_T03.1
tctcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32268 - DNA, 359 bp, Artificial
  MsCOMT deletion introduced by TALEN pair MsCOMT_T03.1
tctcaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32269 - DNA, 351 bp, Artificial
  MsCOMT deletion introduced by TALEN pair MsCOMT_T03.1
tctcaaaaaactcatcaatcacaaccatgggttcaacaggtgcaactcaaataacaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgcaccagttatgttggaccgaatgttgcgtctcttggcttgttacaatatcctcacttgttcagttcgtactcaacaagatggaaagattcagagactttatggtttggctactgttgctaa

SEQ ID NO: 32270 - DNA, 358 bp, Artificial
  MsCOMT deletion introduced by TALEN pair MsCOMT_T03.1
tctcaaaaaactcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32271 - DNA, 357 bp, Artificial
  MsCOMT deletion introduced by TALEN pair MsCOMT_T03.1
tctcaaaaaacctctcaatcacaacaatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32272 - DNA, 359 bp, Artificial
  MsCOMT deletion introduced by TALEN pair MsCOMT_T03.1
tctcaaaaaacctcctcaatcacaaccattggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32273 - DNA, 359 bp, Artificial
  MsCOMT deletion introduced by TALEN pair MsCOMT_T03.1
tctcaaaaaacctcctcaatcacaaccatgggttcaacaggtgaaactccaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32274 - DNA, 359 bp, Artificial
  MsCOMT deletion introduced by TALEN pair MsCOMT_T03.1
tctcaaaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32275 - DNA, 360 bp, Artificial
  MsCOMT deletion introduced by TALEN pair MsCOMT_T03.1
tctcaaaaaacctcatcaatcacaaccatgggttcagcaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32276 - DNA, 360 bp, Artificial
  MsCOMT deletion introduced by TALEN pair MsCOMT_T03.1
tctcaaaaaacctcatcaatcacaaccatgggttcaacaggtgaaactccaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32277 - DNA, 359 bp, Artificial
  MsCOMT deletion introduced by TALEN pair MsCOMT_T03.1
tctcaaaaaacctcatcaatcacaaccatgggttcaacaggtgaaactcaaatcacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagcctttatggtttggctactgttgctaa

SEQ ID NO: 32278 - DNA, 359 bp, Artificial
  MsCOMT deletion introduced by TALEN pair MsCOMT_T03.1
tctcaaaaaacctcatcaatcacaaccatgggttcaacaggtgaaactcaaatcacaccaacccacatatcagatgaagaagcaaacctcttcgccatgcaattagcaagtgcttcagttcttcccatgattttaacatcagctcttgaacttgatctcttagaaatcattgctaaagctggacctggtgctcaaatttcacctattgaaattgcttctcagctcccaacatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32279 - DNA, 356 bp, Artificial
  MsCOMT deletion introduced by TALEN pair MsCOMT_T03.1
tctcaaaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32280 - DNA, 359 bp, Artificial
  MsCOMT deletion introduced by TALEN pair MsCOMT_T03.1
tctcaaaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32281 - DNA, 346 bp, Artificial
  MsCOMT deletion introduced by TALEN pair MsCOMT_T03.1
tctcaaaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32282 - DNA, 360 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctattgaaattgcttctcagctcccaacaacccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32283 - DNA, 360 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32284 - DNA, 359 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccattcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32285 - DNA, 359 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgctactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgctgctaa

SEQ ID NO: 32286 - DNA, 360 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32287 - DNA, 361 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32288 - DNA, 360 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32289 - DNA, 354 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32290 - DNA, 411 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaggcgctggagacggtgcaggcgctgttgccggtgctgtgccaggcccacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32291 - DNA, 357 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatgcaccagttatgttggaccgaatgttgcgtctcttggcttgttacaatatcctcacttgttcagttcgtactcaacaagatggaaagattcagagactttatggtttggctactgttgctaa

SEQ ID NO: 32292 - DNA, 359 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32293 - DNA, 359 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctag

SEQ ID NO: 32294 - DNA, 386 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactcttcctggctagcggtacgcgtaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32295 - DNA, 362 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32296 - DNA, 360 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32297 - DNA, 361 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32298 - DNA, 360 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggtttagagactttatggtttggctactgtgctaa

SEQ ID NO: 32299 - DNA, 355 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32300 - DNA, 350 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaagattcagagactttatggtttggctactgttgctaa

SEQ ID NO: 32301 - DNA, 431 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaattttattttgactgatagtgacctgttcgttgcaacaaattgataagcaatgctttcttataatgccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32302 - DNA, 360 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatactcacttgttcagttcgtactcaacaagatggaaaggttcagagactttatggtttggctactgttgctaa

SEQ ID NO: 32303 - DNA, 327 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcactgatgcaccagttatgttggaccgaatgttgcgtctcttggcttgttacaatatcctcacttgttcagttcgtactcaacaagatggaaaggttcagagactttatggtttggctactgttgcta

SEQ ID NO: 32304 - DNA, 354 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatatgcaccagttatgttggaccgaatgttgcgtctcttggcttgttacaatatcctcacttgttcagttcgtactcaacaagatggaaagattcagagactttatggtttggctactgttgctaa

SEQ ID NO: 32305 - DNA, 356 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32306 - DNA, 352 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacacaccagttatgttggaccgaatgttgcgtctcttggcttgttacaatatcctcactttttcagttcgtactcaacaagatggaaagattcagagactttatggtttggctactgttgctaa

SEQ ID NO: 32307 - DNA, 355 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 32308 - DNA, 359 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32309 - DNA, 359 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32310 - DNA, 358 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 32311 - DNA, 360 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32312 - DNA, 358 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32313 - DNA, 431 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaattttattttgactgatagtgacctgttcgttgcaacaaattgataagcaatgctttcttataatgccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32314 - DNA, 340 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaccagttatgttggaccgaatgttgcgtctcttggcttgttacaatatcctcacttgttcagttcgtactcaacaagatggaaaggttcagagactttatggtttggctactgttgctaa

SEQ ID NO: 32315 - DNA, 348 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaacttatgttggaccgaatgttgcgtctcttggcttgttacaatatcctcacttgttcagttcgtactcaacaagatggaaaggttcagagactttatggtttggctactgttgctaa

SEQ ID NO: 32316 - DNA, 360 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccaacaaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32317 - DNA, 363 bp, Artificial
  MsCOMT deletion introduced by TALEN pair MsCOMT_T03.1
tctcaaaaaacctcatcaatcacaaccatgggttcaacaggtgaaactcaaataacaccaacccacatatcagatgaagaagcaaacctcttcgccatacaattagcaagtgcttcagttcttcccatgattttaaaatcagctcttgaacttgatctcttagaaatcattgctaaagctggacctggtgctcaaatttcacctattgaaattgcttctcagctcccaacaactacctgttgcaccagttatgttggaccgaatgttgcgtctcttggcttgttacaatatcctcacttgttcagttcgtactcaacaagatggaaaggttcagagactttatggtttggctactgttgctaa

SEQ ID NO: 32318 - DNA, 359 bp, Artificial
  MsCOMT deletion introduced by TALEN pair MsCOMT_T03.1
tctcaaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggacggaatgttgcgactcttggagggttacaatatcctcacttgtgcagttcgtactcaacaagatggaaaggttcagagacttggtggtttggggactttagataa

SEQ ID NO: 32319 - DNA, 352 bp, Artificial
  MsCOMT deletion introduced by TALEN pair MsCOMT_T03.1
tctcaaaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32320 - DNA, 359 bp, Artificial
  MsCOMT deletion introduced by TALEN pair MsCOMT_T03.1
tctcaaaaaaacagcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32321 - DNA, 357 bp, Artificial
  MsCOMT deletion introduced by TALEN pair MsCOMT_T03.1
tctacatcaatcacaaccatggtttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32322 - DNA, 454 bp, Artificial
  MsCOMT deletion introduced by TALEN pair MsCOMT_T03.1
tctacaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaaccaggcccacggcttgaccccccagcaggtggtggccatcgccagcaatggcggtggcaagcaggcgctggagacggtccagcggctgttgccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32323 - DNA, 351 bp, Artificial
  MsCOMT deletion introduced by TALEN pair MsCOMT_T03.1
tctacaaaacctcatcaatcacaaccatgggttcaacaggtgaaactcaaataacaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaacctatgttggaccgaatgttgcgtctcttggcttgttacaatatcctcacttgttcagttcgtactcaacaagatggaaagattcagagactttatggtttggctactgttgctaa

SEQ ID NO: 32324 - DNA, 365 bp, Artificial
  MsCOMT deletion introduced by TALEN pair MsCOMT_T03.1
tctacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaactaacccctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32325 - DNA, 360 bp, Artificial
  MsCOMT deletion introduced by TALEN pair MsCOMT_T03.1
tctacaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32326 - DNA, 359 bp, Artificial
  MsCOMT deletion introduced by TALEN pair MsCOMT_T03.1
tctacaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32327 - DNA, 359 bp, Artificial
  MsCOMT deletion introduced by TALEN pair MsCOMT_T03.1
tctacaaaaaccttcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32328 - DNA, 356 bp, Artificial
  MsCOMT deletion introduced by TALEN pair MsCOMT_T03.1
tctacaaaaacctcctcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32329 - DNA, 351 bp, Artificial
  MsCOMT deletion introduced by TALEN pair MsCOMT_T03.1
tctacaaaaacctcctcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32330 - DNA, 348 bp, Artificial
  MsCOMT deletion introduced by TALEN pair MsCOMT_T03.1
tctacaaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctatgcaccagttatgttggaccgaatgttgcgtctcttggcttgttacaatatcctcacttgttcagttcgtactcaacaagatggaaagattcagagactttatggtttggctactgttgctaa

SEQ ID NO: 32331 - DNA, 357 bp, Artificial
  MsCOMT deletion introduced by TALEN pair MsCOMT_T03.1
tctacaaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32332 - DNA, 359 bp, Artificial
  MsCOMT deletion introduced by TALEN pair MsCOMT_T03.1
tctacaaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32333 - DNA, 360 bp, Artificial
  MsCOMT deletion introduced by TALEN pair MsCOMT_T03.1
tctacaaaaacctcatcatcacaaccatgggttcaacaggtgaaactcacataacaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32334 - DNA, 424 bp, Artificial
  MsCOMT deletion introduced by TALEN pair MsCOMT_T03.1
tctacaaaaacctcatcaatcacaaccattggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaaccggcaagcagccgctggaccgtctccagcgcctgctgccggtgctgtgctggcgatggccaccacccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32335 - DNA, 358 bp, Artificial
  MsCOMT deletion introduced by TALEN pair MsCOMT_T03.1
tctacaaaaacctcatcaatcacaaccatgggttcaacaggtgaaactcaaatcacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32336 - DNA, 433 bp, Artificial
  MsCOMT deletion introduced by TALEN pair MsCOMT_T03.1
tctacaaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccagccactcagccgcgggtttctggagtttaatgagctaagcacatacgtcagaaaccattattgcgcgttcaaaagtcactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32337 - DNA, 354 bp, Artificial
  MsCOMT deletion introduced by TALEN pair MsCOMT_T03.1
tctacaaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaagattcagagactttatggtttggctactgttgctaa

SEQ ID NO: 32338 - DNA, 356 bp, Artificial
  MsCOMT deletion introduced by TALEN pair MsCOMT_T03.1
tctacaaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacagatgcaccagttatgttggaccgaatgttgcgtctcttggcttgttacaatatcctcacttgttcagttcgtactcaacaagatggaaagattcagagactttatggtttggctactgttgctaa

SEQ ID NO: 32339 - DNA, 357 bp, Artificial
  MsCOMT deletion introduced by TALEN pair MsCOMT_T03.1
tctacaaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32340 - DNA, 352 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagcttccaatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32341 - DNA, 359 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32342 - DNA, 359 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactcatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32343 - DNA, 364 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaactaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32344 - DNA, 248 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttggcttgttacaatatcctcacttgttcagttcgtactcaacaagatggaaagattcagagactttatggtttggctactgttgctaa

SEQ ID NO: 32345 - DNA, 309 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcgtctcttggcttgttacaatatcctcacttgttctgttcgtactcaacaagatggaaaggttcagagactttatggtttggctactgttgctaa

SEQ ID NO: 32346 - DNA, 337 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctatgttggaccgaatgttgcgtctcttggcttgttacaatatcctcacttgttcagttcgtactcaacaagatggaaagattcagagactttatggtttggctactgttgctaa

SEQ ID NO: 32347 - DNA, 358 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacactgatgcaccagtcatgttggaccgaatgttgcgtctcttggcttgttacaatatcctcacttgttcagttcgtactcaacaagatggaaaggttcagagactttatggtttggctactgttgctaa

SEQ ID NO: 32348 - DNA, 288 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaacgtactcaacaagatggaaaggttcagagactttatggtttggctactgttgctaa

SEQ ID NO: 32349 - DNA, 360 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacaaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32350 - DNA, 356 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgcaccagttatgttggaccgaatgttgcgtctcttggcttgttacaatatcctcacttgttcagttcgtactcaacaagatggaaagattcagagactttatggtttggctactgttgctaa

SEQ ID NO: 32351 - DNA, 359 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 32352 - DNA, 359 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32353 - DNA, 386 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactcttcctggctagcggtacgcgtaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32354 - DNA, 361 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32355 - DNA, 353 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32356 - DNA, 355 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32357 - DNA, 355 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32358 - DNA, 359 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 32359 - DNA, 359 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32360 - DNA, 359 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32361 - DNA, 359 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagaggctttatggtttggctactgttgctaa

SEQ ID NO: 32362 - DNA, 360 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgacctcttagaaatcattgctaaagctggacctggtgctcaaatttcacctgttcaaattgcttctcagcttccaacaacctgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32363 - DNA, 360 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32364 - DNA, 360 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32365 - DNA, 355 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32366 - DNA, 357 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32367 - DNA, 354 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacatgcaccagttatgttggaccgaatgttgcgtcacttggcttgttacaatatcctcacttgttcagttcgtactcaacaagatggaaaggttcagagactttatggtttggctactgttgctaa

SEQ ID NO: 32368 - DNA, 331 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacttgcgtctcttggcttgttacaatatcctcacttgttcagttcgtactcaacaagatggaaagattcagagactttatggtttggctactgttgctaa

SEQ ID NO: 32369 - DNA, 359 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32370 - DNA, 359 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32371 - DNA, 393 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaactccagcgcctgcttgccgccatcgtggccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32372 - DNA, 439 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaaccagaccaggaacaagcacatcaaccccaacgagtggtggaaggtgtacccctccagcgtgaccgagttcaagttcctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32373 - DNA, 360 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32374 - DNA, 361 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32375 - DNA, 269 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcaacaagatggaaaagttcagagactttatggtttggctactgttgctaa

SEQ ID NO: 32376 - DNA, 259 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctctatgttggaccgaatgttgcgtctcttggcttgttacaatatcctcacttgttcagttcgtactcaacaagatggaaaggttcagagactttatggtttggctactgttgctaa

SEQ ID NO: 32377 - DNA, 344 bp, Artificial
  MsCOMT deletion introduced by TALEN pair MsCOMT_T03.1
tctacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacgttggaccgaatgttgcgtctcttggcttgttacaatatcctcacttgttcagttcgtactcaacaagatggaaaggttcagagactttatggtttggctactgttgctaa

SEQ ID NO: 32378 - DNA, 359 bp, Artificial
  MsCOMT deletion introduced by TALEN pair MsCOMT_T03.1
tctacaaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttctgttcgtactcaacaagatggaaagattcagagactttatggtttggctactgttgctaa

SEQ ID NO: 32379 - DNA, 357 bp, Artificial
  MsCOMT deletion introduced by TALEN pair MsCOMT_T03.1
tctacaaaaaccatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32380 - DNA, 369 bp, Artificial
  MsCOMT deletion introduced by TALEN pair MsCOMT_T03.1
tctacaaaaacatcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32381 - DNA, 362 bp, Artificial
  MsCOMT deletion introduced by TALEN pair MsCOMT_T03.1
tctaacaaaaacctcatcaatcacaaccatgggttcaacaggtgaaactcaaataacaccaacccacatatcagatgaagaagcaaacctcttcgccatgcaattagcaagggcttcagttcttcccatgattttaaaatcagctcttgaacttgatctcttagaaatcattgctaaagctggacctggtgctcaaatttcacctattgaaattgcttctcagctcccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32382 - DNA, 356 bp, Artificial
  MsCOMT deletion introduced by TALEN pair MsCOMT_T03.1
tctaacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32383 - DNA, 351 bp, Artificial
  MsCOMT deletion introduced by TALEN pair MsCOMT_T03.1
tctaaaacctcatcaatcacaaccatgggttcaacaggtgaaactcaaataacaccaacccacatatcagatgaagaagcaaccctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32384 - DNA, 359 bp, Artificial
  MsCOMT deletion introduced by TALEN pair MsCOMT_T03.1
tctaaaaaacctcatcaatcacaaccatgggttcaacaggtgaaactcaaataacaccaacccacatatcagatgaagaagccaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaataacctcacttgttcagttcgtactcaacaagatggaaaggttcagagactttatggtttggctactgttgctaa

SEQ ID NO: 32385 - DNA, 359 bp, Artificial
  MsCOMT deletion introduced by TALEN pair MsCOMT_T03.1
tcgcacaaaaacctcatcaatcgggggcaggggttcaacaggtgaaactcaactaacaccaacccacatatccccttcagaagcaaacctcttcgccatgcaactagcaagtgcttcagttcttcccatgattttgaaatcagctcttgaacttgatctcttagaaatcattgctaaagctggacctggtgctcaaatcgcacctattgaaattgcttctcagctaccaacaattatgcaccagttatgttggaccgaatgttgcgtctctttgctttgtgcaatagcatcacttgttcggttcgtactcaacaaggtggaaaagtgaagagactttatggtttggctactgttgctaa

SEQ ID NO: 32386 - DNA, 356 bp, Artificial
  MsCOMT deletion introduced by TALEN pair MsCOMT_T03.1
tcgcacaaaaacctcatcaatcacaaccaggggttcaacgggtgaaactcaaataacaccaacccacatatcagatgaagaggcaaacctcttggccatgcaactagcaagtgcttcagttcttcccatgattttgaaatcagctcttgaacttgatctcttagaaatcattgctaaagctggacctggtgctcaaatttcacctattgaaattgcttctcagctaccaacgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32387 - DNA, 361 bp, Artificial
  MsCOMT deletion introduced by TALEN pair MsCOMT_T03.1
tcctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32388 - DNA, 356 bp, Artificial
  MsCOMT deletion introduced by TALEN pair MsCOMT_T03.1
tccccaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacctgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32389 - DNA, 351 bp, Artificial
  MsCOMT deletion introduced by TALEN pair MsCOMT_T03.1
tcccacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttctgttcgtactcaacaagatggaaaggttcagagcctttatggtttggctactgttgctaa

SEQ ID NO: 32390 - DNA, 362 bp, Artificial
  MsCOMT deletion introduced by TALEN pair MsCOMT_T03.1
tcccacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32391 - DNA, 359 bp, Artificial
  MsCOMT deletion introduced by TALEN pair MsCOMT_T03.1
tcccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactattgctaa

SEQ ID NO: 32392 - DNA, 277 bp, Artificial
  MsCOMT deletion introduced by TALEN pair MsCOMT_T03.1
tcccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaagatggaaagattcagagactttatggtttggctactgttgctaa

SEQ ID NO: 32393 - DNA, 439 bp, Artificial
  MsCOMT deletion introduced by TALEN pair MsCOMT_T03.1
tcccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactatgccggtgctgtgccaggcccacggcttgaccccggagcaggtggtggccatcgccagccacgatggcggcaagcactgatgcaccagttatgttggaccgaatgttgcgtctcttggcttgttacaatatcctcacttgttctgttcgtactcaacaagatggaaaggttcagagactttatggtttggctactgttgctaa

SEQ ID NO: 32394 - DNA, 395 bp, Artificial
  MsCOMT deletion introduced by TALEN pair MsCOMT_T03.1
tcccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaccggcaacagccgctggaccgtctccagcaccctgatgcaccatttatgttggaccgaatgttgcgtctcttggcttgttacaatatcctcactttttcagttcgtactcaacaagatggaaagattcagagactttatggtttggctactgttgctaa

SEQ ID NO: 32395 - DNA, 361 bp, Artificial
  MsCOMT deletion introduced by TALEN pair MsCOMT_T03.1
tcccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32396 - DNA, 358 bp, Artificial
  MsCOMT deletion introduced by TALEN pair MsCOMT_T03.1
tcccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32397 - DNA, 360 bp, Artificial
  MsCOMT deletion introduced by TALEN pair MsCOMT_T03.1
tcccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32398 - DNA, 353 bp, Artificial
  MsCOMT deletion introduced by TALEN pair MsCOMT_T03.1
tcccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32399 - DNA, 364 bp, Artificial
  MsCOMT deletion introduced by TALEN pair MsCOMT_T03.1
tcccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32400 - DNA, 361 bp, Artificial
  MsCOMT deletion introduced by TALEN pair MsCOMT_T03.1
tcccacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacctgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32401 - DNA, 361 bp, Artificial
  MsCOMT deletion introduced by TALEN pair MsCOMT_T03.1
tcccacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacatgatctcttagaaatcattgctaaagctggaccttgtgctcaaatttcacctattgaaattgcttctcagctcccaacaacctgatgcaccagttatgttggaccgaattttgcgtctcttggcttgttacaatatcctcacttgttcagttcgttctcaacaagatggaaaggttcagagactttatggtttggctactgttgctaa

SEQ ID NO: 32402 - DNA, 350 bp, Artificial
  MsCOMT deletion introduced by TALEN pair MsCOMT_T03.1
tcccacaaaaacctcatcaatcacaaccatgggttcaacaggtgaaactcaaataacaccaacccacatatcagatgaagaagcaaacctcttcgccatgaaactagcaagtgcttcagttcttcccatgattttgaaatcagctcttgaacttgatctcttagaaatcattgctaaagctggacctggtgctcaaatttcacctattgaaattgcttctcacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32403 - DNA, 312 bp, Artificial
  MsCOMT deletion introduced by TALEN pair MsCOMT_T03.1
tcccacaaaaacctcatcaatcacaaccatgggttcaacaggtgaaactcaaacaacaccaacccacatatcagatgaagaagcaaacctcttcgccatgcaattagcaagtgcttcagttcttcccatgattttaaaatcagctcttgaacttgatctcttagaaatcattgctaaagctggacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32404 - DNA, 359 bp, Artificial
  MsCOMT deletion introduced by TALEN pair MsCOMT_T03.1
tccacaaaaacctcctcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32405 - DNA, 359 bp, Artificial
  MsCOMT deletion introduced by TALEN pair MsCOMT_T03.1
tccacaaaaacctcatcaatcacaaccatgggttcaacaggtgaaactcaaatcacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttctcctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32406 - DNA, 360 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctgttcaaattgcttctcagcttccaacaaactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32407 - DNA, 356 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32408 - DNA, 359 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcccttgttcagttcgtactcaacaagatggaaaggttcagagactttatggtttggctactgttgctaa

SEQ ID NO: 32409 - DNA, 424 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaacggggtcaagccgtgggcctggcacagcaccggcaacagccgctggaccgtctccagcgccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32410 - DNA, 356 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaaatgcaccagttatgttggaccgaatgttgcgtctcttggcttgttacaatatcctcacttgttcagttcgtactcaacaagatggaaagattcagagactttatggtttggctactttgctaa

SEQ ID NO: 32411 - DNA, 343 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctccagttatgttggaccgaatgttgcgtctcttggcttgttacaatatcctcacttgttcagttcgtactcaacaagatggaaagattcagagactttatggtttggctactgttgctaa

SEQ ID NO: 32412 - DNA, 361 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacaactctgatgcaccagtcatgttggaccgaatgttgcgtctcttggcttgttacaatatcctcacttgttctgttcgtactcaacaagatggaaaggttcagagactttatggtttggctactggtgctaa

SEQ ID NO: 32413 - DNA, 358 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32414 - DNA, 357 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32415 - DNA, 392 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactggcacagcaccggcaacagccgctggaccgtctccagcaccagttatgttggaccgaatgttgcgtctcttggcttgttacaatatcctcacttgttcagttcgtactcaacaagatggaaaggttcagagactttatggtttggctactgttgctaa

SEQ ID NO: 32416 - DNA, 359 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagtcatgttggaccgaatattgcgtctcttggcttgttacaatatcctcacttgttctgttcgtactcagcaagatggaaaggttcagagactttatggtttggctactgttgctaa

SEQ ID NO: 32417 - DNA, 429 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacccacggcttgaccccggagcaggtggtggccatcgccagccacgatggcggcaagcaggcgctggactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32418 - DNA, 359 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactaacgcaccagttatgttggaccgaatgttgcgtctcttggcttgttacaatatcctcacttgttcagttcgtactcaacaagatggaaaggttcagagactttatggtttggctactgttgctaa

SEQ ID NO: 32419 - DNA, 361 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32420 - DNA, 361 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32421 - DNA, 328 bp, Artificial
  MsCOMT deletion introduced by TALEN pair MsCOMT_T03.1
tccacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagaccgaatgttgcgtctcttggcttgttacaatatcctcacttgttcagttcgtactcaacaagatggaaagattcagagactttatggtttggctactgttgctaa

SEQ ID NO: 32422 - DNA, 356 bp, Artificial
  MsCOMT deletion introduced by TALEN pair MsCOMT_T03.1
tccaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaactgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32423 - DNA, 354 bp, Artificial
  MsCOMT deletion introduced by TALEN pair MsCOMT_T03.1
tccaaaaaacctcatcaatcacaaccatgggttcaacaggtgaaactcaaataacaccaacccacatatcagatgaagaagcaaacctcttcgccattcaactagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaagattcagagactttatggtttggctactgttgctaa

SEQ ID NO: 32424 - DNA, 360 bp, Artificial
  MsCOMT deletion introduced by TALEN pair MsCOMT_T03.1
tcacacaaaaacctcatcaatcacaaccatgggttcaacaggtgaaactcaaataacaccaacccacatatcagatgaagaagcaaccctcttcgccatgcaattagcaagtgcttcagttcttcccatgattttaaaatcagctcttgaacttgatctcttagaaatcattgctaaagctggacctgatgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32425 - DNA, 360 bp, Artificial
  MsCOMT deletion introduced by TALEN pair MsCOMT_T03.1
tcacacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32426 - DNA, 351 bp, Artificial
  MsCOMT deletion introduced by TALEN pair MsCOMT_T03.1
tcacacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaccagttatgttggaccgaatgttgcgtctcttggcttgttacaatatcctcacttgttcagttcgtactcaacaagatggaaaggttcagagactttatggtttggctactgttgctaa

SEQ ID NO: 32427 - DNA, 358 bp, Artificial
  MsCOMT deletion introduced by TALEN pair MsCOMT_T03.1
tcacacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaagttcagagactttatggtttggctactgctaa

SEQ ID NO: 32428 - DNA, 358 bp, Artificial
  MsCOMT deletion introduced by TALEN pair MsCOMT_T03.1
tcacaaaaacctcatcaatcacaaccatgggttcaacaggtgcaactcaaataccaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32429 - DNA, 358 bp, Artificial
  MsCOMT deletion introduced by TALEN pair MsCOMT_T03.1
tcacaaaaacctcatcaatcacaaccatgggttcaacaggtgcaactcaaataccaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32430 - DNA, 351 bp, Artificial
  MsCOMT deletion introduced by TALEN pair MsCOMT_T03.1
tcacaaaaacctcatcaatcacaaccatgggttcaacaggtgcaactcaaataacaccaacccacatatcagatgaagaagcaaacctcttcgccattcaattagcaagtgcttcagttcttcccatgattttaaaatcagctcttgaacttgatctcttagaaatcattgctaaagctggacctggtgctcaaatttcacctactgaaattgcttctcagctcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32431 - DNA, 347 bp, Artificial
  MsCOMT deletion introduced by TALEN pair MsCOMT_T03.1
tcacaaaaacctcatcaatcacaaccatgggttcaacaggtgcaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatttatgttggaccgaatgttgtgtctcttggcttgttacaatatcctcacttgttcagttcgtactcaacaagatggaaaggttcagagactttatggtttggctactgttgctaa

SEQ ID NO: 32432 - DNA, 358 bp, Artificial
  MsCOMT deletion introduced by TALEN pair MsCOMT_T03.1
tcacaaaaacctcatcaatcacaaccatgggttcaacaggtgaaactcaaataactccaacccacatatcagatgaagaagcaaacctcttcgccattcacttagcaagtgcttcagttcttcccatgattttaaaatcagctcttgaacttgatctcttagaaatcattgctaaagctggaccttgtgctcaaatttcacctattgaaattgcttctcagctcccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 32433 - DNA, 419 bp, Artificial
  MsCOMT deletion introduced by TALEN pair MsCOMT_T03.1
tcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgaccccccagcaggtggtggccatcgccagcaatggcggtggcaagcaggcgctggaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32434 - DNA, 350 bp, Artificial
  MsCOMT deletion introduced by TALEN pair MsCOMT_T03.1
tcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccagttatgttggaccgaatgttgcgtctcttggcttgttacaatatcctcacttgttcagttcgtactcaacaagatggaaaggttcagagactttatggtttggctactgttgctaa

SEQ ID NO: 32435 - DNA, 360 bp, Artificial
  MsCOMT deletion introduced by TALEN pair MsCOMT_T03.1
tcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32436 - DNA, 388 bp, Artificial
  MsCOMT deletion introduced by TALEN pair MsCOMT_T03.1
tcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacggatggcctttttgcgtttctacaaactcctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32437 - DNA, 353 bp, Artificial
  MsCOMT deletion introduced by TALEN pair MsCOMT_T03.1
tcaaaaacctcatcaatcacaaccatgggttcaacaggtgaacctcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacagatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32438 - DNA, 354 bp, Artificial
  MsCOMT deletion introduced by TALEN pair MsCOMT_T03.1
tcaaaaacctcatcaatcacaaccatgggttcaacaggtgaaactcaaataacaccaacccacatatcagatgaagaagcaaacctcttcgccatgcaattagcaagtgcttcagttcttcccaagattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32439 - DNA, 358 bp, Artificial
  MsCOMT deletion introduced by TALEN pair MsCOMT_T03.1
tcaaaaaactcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32440 - DNA, 232 bp, Artificial
  MsCOMT deletion introduced by TALEN pair MsCOMT_T03.1
tcaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgacttgttacaatatcctcacttgttcagttcgtactcaacaagatggaaagattcagagactttatggtttggctactgttgctaa

SEQ ID NO: 32441 - DNA, 358 bp, Artificial
  MsCOMT deletion introduced by TALEN pair MsCOMT_T03.1
tatcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactagcaccagttatgttggaccgaatgttgcgtctcttggcttgttacaatatcctcacttgttcagttcgtactcaacaagatggaaagattcagagactttatggtttggctactgttgctac

SEQ ID NO: 32442 - DNA, 370 bp, Artificial
  MsCOMT deletion introduced by TALEN pair MsCOMT_T03.1
tatcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatatcttagaaatcattgctaaagctagacctggtgctcaaatttcacctgttcaaattgcttctcagctaccaacaactaaccaaccctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32443 - DNA, 354 bp, Artificial
  MsCOMT deletion introduced by TALEN pair MsCOMT_T03.1
tatcacaaaaacaacatcaatcacaaccatgggtacaacaggtgaaactcaaataacaccaacccacatatcagatgaagaagcaaaactcttcgccatgcaattagcaagtgcttcagttcttacaatgattttaaaatcagctactgaacttgatcacttagaaatcattgctaaagctggaactggtgctcaaatttcacctattgaaattgcttctcagctacctgatgcaccagttatgttggaccgaatgttgcgtctcttggcttgttacaatatcctcacttgttcagttcgtactcaacaagatggaaaggttcagagactttatggtttggctactggtgctaa

SEQ ID NO: 32444 - DNA, 368 bp, Artificial
  MsCOMT deletion introduced by TALEN pair MsCOMT_T03.1
tagtctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32445 - DNA, 347 bp, Artificial
  MsCOMT deletion introduced by TALEN pair MsCOMT_T03.1
tacctcatcaatcacaaccatgtgttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32446 - DNA, 344 bp, Artificial
  MsCOMT deletion introduced by TALEN pair MsCOMT_T03.1
taaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32447 - DNA, 353 bp, Artificial
  MsCOMT deletion introduced by TALEN pair MsCOMT_T03.1
taaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagctcccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32448 - DNA, 353 bp, Artificial
  MsCOMT deletion introduced by TALEN pair MsCOMT_T03.1
gtctcacaaaaacctcatcaatcacaaccatgggttcaacaggtgaaactcaaataacaccaacccacatatcagatgaagacgcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccatgcaccagttatgttggaccgaatgttgcgtctcttggcttgttacaatatcctcacttgttcagttcgtactcaacaagatggaaagattcagagactttatggtttggctactgttgctaa

SEQ ID NO: 32449 - DNA, 318 bp, Artificial
  MsCOMT deletion introduced by TALEN pair MsCOMT_T03.1
gtctcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgtgatgcaccagttatgttggaccgagtgttgcgtctcttggcttgttacaatatcctcacttgttcagttcgtactcaacaagatggaaaggttcagagactttatggtttggctactgttgctaa

SEQ ID NO: 32450 - DNA, 360 bp, Artificial
  MsCOMT deletion introduced by TALEN pair MsCOMT_T03.1
gtctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32451 - DNA, 462 bp, Artificial
  MsCOMT deletion introduced by TALEN pair MsCOMT_T03.1
gtctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactacggctacactagaagaacagtatttggtatctgcgctctgctgaagccagttaccttcggaaaaagagttggtagctcttgatccggcaaacaaaccaccgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32452 - DNA, 363 bp, Artificial
  MsCOMT deletion introduced by TALEN pair MsCOMT_T03.1
gtctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32453 - DNA, 358 bp, Artificial
  MsCOMT deletion introduced by TALEN pair MsCOMT_T03.1
gctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32454 - DNA, 362 bp, Artificial
  MsCOMT deletion introduced by TALEN pair MsCOMT_T03.1
gctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttctgttcgtactcaacaagatggaaaggttcagagactttatggtttggctactgttgctac

SEQ ID NO: 32455 - DNA, 355 bp, Artificial
  MsCOMT deletion introduced by TALEN pair MsCOMT_T03.1
ctcacccccacctcatcaatcacaaccatgtgttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggttctcaaatttcacctattgaaattgcttctcagctaccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32456 - DNA, 358 bp, Artificial
  MsCOMT deletion introduced by TALEN pair MsCOMT_T03.1
ctcacaaaaacctcctcaatcacaaccatgggttcaacaggtgaaactccaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32457 - DNA, 357 bp, Artificial
  MsCOMT deletion introduced by TALEN pair MsCOMT_T03.1
ctcacaaaaacctcatcaatcacaaccatgggttcaacaggtgaaactcaaatcacaccaacccacatatcagatgaagaagcaaacctcttcgccatgcaattagcaagtgcttcagttcttcccatgattttgaaatcagctcttgaacttgatctcttagaaatcattgctaaagctggacctggtgcccaaatttcacctattgaaattgcttctcagctcccaacatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32458 - DNA, 355 bp, Artificial
  MsCOMT deletion introduced by TALEN pair MsCOMT_T03.1
ctcacaaaaacctcatcaatcacaaccatgggttcaacaggtgaaactcaaatcacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32459 - DNA, 360 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32460 - DNA, 360 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32461 - DNA, 367 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactaaccccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32462 - DNA, 343 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32463 - DNA, 360 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttaaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32464 - DNA, 354 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctgttcaaattgcttctcagcttccaacatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32465 - DNA, 354 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaatatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32466 - DNA, 358 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32467 - DNA, 360 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32468 - DNA, 360 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaacttgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32469 - DNA, 359 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32470 - DNA, 358 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32471 - DNA, 354 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacacgcaccagttatgttggaccgaatgttgcgtctcttggcttgttacaatatcctcacttgttcagttcgtactcaacaagatggaaaggttcagagactttatggtttggctactgttgctaa

SEQ ID NO: 32472 - DNA, 359 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32473 - DNA, 360 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32474 - DNA, 350 bp, Artificial
  MsCOMT deletion introduced by TALEN pair MsCOMT_T03.1
ctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaacagttatgttggaccgaatgttgcgtctcttggcttgttacaatatcctcacttgttcagttcgtactcaacaagatggaaaagttcagagactttatggtttggctactgttgctaa

SEQ ID NO: 32475 - DNA, 355 bp, Artificial
  MsCOMT deletion introduced by TALEN pair MsCOMT_T03.1
ctcaaaaaccatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32476 - DNA, 359 bp, Artificial
  MsCOMT deletion introduced by TALEN pair MsCOMT_T03.1
cctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagcttccaacactgatgcaccagtcatgttggaccgaatgttgcgtctcttggcttgttacaatatcctcacttgttctgttcgtactcaacaagatggaaaggttcagagactttatggtttggctactgttgctaa

SEQ ID NO: 32477 - DNA, 358 bp, Artificial
  MsCOMT deletion introduced by TALEN pair MsCOMT_T03.1
cctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctgttcaaattgcttctcagctaccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32478 - DNA, 345 bp, Artificial
  MsCOMT deletion introduced by TALEN pair MsCOMT_T03.1
cctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacgttggaccgaatgtttcgtctcttggcttgttacaatatcctcacttgttcagttcgtactcaacaagatggaaaggttcagagactttatggtttggctactgttgctaa

SEQ ID NO: 32479 - DNA, 361 bp, Artificial
  MsCOMT deletion introduced by TALEN pair MsCOMT_T03.1
cctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32480 - DNA, 362 bp, Artificial
  MsCOMT deletion introduced by TALEN pair MsCOMT_T03.1
cctcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32481 - DNA, 360 bp, Artificial
  MsCOMT deletion introduced by TALEN pair MsCOMT_T03.1
cctcacaaaaacctcatcaatcacaaccatgggttcaacaggtgaaactcaaataacaccaacccacatatcagatgaagaagcaaacctcttcgccatgcaagtagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32482 - DNA, 355 bp, Artificial
  MsCOMT deletion introduced by TALEN pair MsCOMT_T03.1
cctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctcccaagatgcaccagttatgttggaccgaatgttgcgtctcttggcttgttacaatatcctcacttgttctgttcgtactcaacaagatggaaaggttcagagactttatggtttggctactgttgctaa

SEQ ID NO: 32483 - DNA, 360 bp, Artificial
  MsCOMT deletion introduced by TALEN pair MsCOMT_T03.1
cctcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32484 - DNA, 359 bp, Artificial
  MsCOMT deletion introduced by TALEN pair MsCOMT_T03.1
cctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtacccaacaagatggaaaggttcagagactttatggtttggctactgttgctaa

SEQ ID NO: 32485 - DNA, 361 bp, Artificial
  MsCOMT deletion introduced by TALEN pair MsCOMT_T03.1
cctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32486 - DNA, 361 bp, Artificial
  MsCOMT deletion introduced by TALEN pair MsCOMT_T03.1
cctcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaaccctgatgcaccagttatgttggaccgaatgttgcgtctcttggcttgttacaatatcctcacttgttcagttcgtactcaacaagatggaaagattcagagactttatggtttggcactgttgctaa

SEQ ID NO: 32487 - DNA, 357 bp, Artificial
  MsCOMT deletion introduced by TALEN pair MsCOMT_T03.1
cccaaaaacctcatcaatcacaaccatgggttcaacaggtgaaactcaaataacaccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactaatgcaccagttatgttggaccgaatgttgcgtctcttggcttgttacaatatcctcacttgttcagttcgtactcaacaagatggaaagattcagagactttatggtttggctactgttgctaa

SEQ ID NO: 32488 - DNA, 355 bp, Artificial
  MsCOMT deletion introduced by TALEN pair MsCOMT_T03.1
cccaaaaacctcatcaatcacaaccatgggttcaacaggtgaaactcaaataacaccaacccacatatcagatgaagaagcacacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32489 - DNA, 351 bp, Artificial
  MsCOMT deletion introduced by TALEN pair MsCOMT_T03.1
cacaaaaacctcatcaatcacaaccatgggttcaacaggtgacactcaaataacaccaacccacatatcagatgaagaagcaaacctcttcgccatgcaactagcaagtgcctcagttcttcccatgattttgaaatcagctcttgaacttgatctcttagaaatcattgctaaagctggacctggtgctcaaatttcacctattgaaattgcttctcagctcccaaatgcaccagttatgttggaccgaatgttgcgtctcttggcttgttacaatatcctcacttgttcagttcgtactcaacaagatggaaagattcagagactttatggtttggctactgttgctaa

SEQ ID NO: 32490 - DNA, 351 bp, Artificial
  MsCOMT deletion introduced by TALEN pair MsCOMT_T03.1
caaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32491 - DNA, 355 bp, Artificial
  MsCOMT deletion introduced by TALEN pair MsCOMT_T03.1
caaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32492 - DNA, 356 bp, Artificial
  MsCOMT deletion introduced by TALEN pair MsCOMT_T03.1
caaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32493 - DNA, 438 bp, Artificial
  MsCOMT deletion introduced by TALEN pair MsCOMT_T03.1
aggcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggggttcaaatttcacctattgaaattgcttctcagctcccaacaccccagcaggtggtgtccatcgccagcaatgggggtggcaagcaggcgctggagacggtccagcggctgttgccggtgcctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32494 - DNA, 361 bp, Artificial
  MsCOMT deletion introduced by TALEN pair MsCOMT_T03.1
actcacaaaaacctcatcaatcacaaccatgggttcaacagtggaaactcaaataacaccaaccctcatatcagatgacgaagcacacctcttcgccatgcaactagcaagtgcttcagttcttcccatgtttttgacatcagctcttgaacttgatctcttagcaagcattgctagagctggacctggtgctcaaatttcacctatggaaattgcttctcagctcccaacaacttgatgcaccagttatgttggaccgaatgttgcgtctcttggcttgttacaatatcctcacttgttcagttcgtactcaacaagatggaaagattcagagactgtatggtttggctactgttgctaa

SEQ ID NO: 32495 - DNA, 356 bp, Artificial
  MsCOMT deletion introduced by TALEN pair MsCOMT_T03.1
actcacaaaaacctcatcaatcacaaccatgggttcaacaggtgaaactcaaataacaccaacccagatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcatctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32496 - DNA, 361 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaattagcaagtgcttcagttcttcccatgattttgaaatcagctcttgaacttgatctcttagaaatcattgctaaagctggacctggtgctcaaatttcacctattgaaattgcttctcagctaccaacaacctgatgcaccagttatgttggaccgaatgttgcgtctcttggcttgttacaatatcctcacttgttcagttcgtactcaacaagatggaaaggttcagagactttatggtttggctactgttgcttt

SEQ ID NO: 32497 - DNA, 356 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccactgatgcaccagttatgttggaccgaatgttgcgtctcttggcttgttacaatatcctcacttgttcagttcgtactcaacaagatggaaagattcagagactttatggtttggctactgttgctac

SEQ ID NO: 32498 - DNA, 356 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaatgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32499 - DNA, 357 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32500 - DNA, 361 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaccctgatgcaccagttatgttggaccgaatgttgcgtctcttggcttgttacaatatcctcacttgttcagttcgtactcaacaagatggaaaggttcagagactttatggtttggctactgttgctac

SEQ ID NO: 32501 - DNA, 404 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactggggtcaagccgtgggcctggcacagcaccggcaacagccgctggatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32502 - DNA, 360 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaagattcagagactttatggtttggctactgttgctat

SEQ ID NO: 32503 - DNA, 361 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32504 - DNA, 357 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaaatgcaccagttatgttggaccgaatgttgcgtctcttggcttgttacaatatcctcacttgttcagttcgtactcaacaagatggaaaggttcagagaccttatggtttggctactgttgctaa

SEQ ID NO: 32505 - DNA, 353 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagccggacctggtgctcaaatttcacctattgaaattgcttctcagctcccaatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32506 - DNA, 359 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaactagcaagtgcttcggttcttcccatgattttgaaatcagctcttgaacttgatctcttagaaatcattgctaaagctggacctggtgctcaaatttcacctattgaaattgcttctcagctcccaacaatgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32507 - DNA, 350 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctagagctggacctggtgctcaaatttcacctattgaaattgcttctcagctaatgcaccagttatgttggaccgaatgttgcgtctcttggcttgttacaatatcctcacttgttctgttcgtactcaacaagatggaaaggttcagagactttatggtttggctactgttgctaa

SEQ ID NO: 32508 - DNA, 356 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacgatgcaccagttattttggaccggatgttgcgtctcttggcttgttacaatatcctcacttgttcagttcgtactcagcaagatggaaaggttcagagactttatggtttggctactgttgctaa

SEQ ID NO: 32509 - DNA, 360 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaggttcagagactttatggtttggctactgttgctac

SEQ ID NO: 32510 - DNA, 362 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactctgatgcaccagttatgttggaccgaatgttgcgtctcttggcttgttacaatatcctcacttgttcagttcgtactcaacaagatggaaaagttcagagactttatggtttggctactgttgctac

SEQ ID NO: 32511 - DNA, 362 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaccctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32512 - DNA, 357 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaaatgcaccagttatgttggaccgaatgttgcgtctcttggcttgttacaatatcctctcttgttcagttcgtactcaacaagatggaaaagttcagagactttatggtttggctactgttgctaa

SEQ ID NO: 32513 - DNA, 360 bp, Artificial
  MsCOMT deletion introduced by TALEN pair MsCOMT_T03.1
actcacaaaaacctcatcaatcacaaccatgggttcaacaggtgaaactcaaataacaccaacccacatatcagatgaagaagcaaacctcttcgccatgcaactagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaagttcagagactttatggtttggctactgttgctac

SEQ ID NO: 32514 - DNA, 347 bp, Artificial
  MsCOMT deletion introduced by TALEN pair MsCOMT_T03.1
acctcatcaatcacaaccatggtttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32515 - DNA, 356 bp, Artificial
  MsCOMT deletion introduced by TALEN pair MsCOMT_T03.1
acaaaaacctcatccatcacaaccatgggttcaacaggtgaacctcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacaactgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32516 - DNA, 360 bp, Artificial
  MsCOMT deletion introduced by TALEN pair MsCOMT_T03.1
aaggaaaaaaacatcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattgcttctcagctaccaacaactgatgcaccagttatgttggaccgaatgttgcgtctcttggcttgttacaatatcctcacttgttcagttcgtactcaacaagatggaaaagttcagagactttatggtttggctactgttgctaa

SEQ ID NO: 32517 - DNA, 349 bp, Artificial
  MsCOMT deletion introduced by TALEN pair MsCOMT_T03.1
aagcacaaaaacaccagaaatcaaaaccaggggcgcaacaggtgaaaagcaaaaaacaacaaccaacacatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaaccagttatgttggaccgaatgttgcgtctcttggcttgttacaatatcctcccttgttcagttcgtactcaacaagatggaaaagttcagagactttatggtttggctactgttgctac

SEQ ID NO: 32518 - DNA, 358 bp, Artificial
  MsCOMT deletion introduced by TALEN pair MsCOMT_T03.1
aaagaaaaaaacctcatcaatcacaaccatgggttcaacaggtgaaactcaaataacaccaacccacatatcagatgaagaagcaaacctcttcgccatgcaattagcaagtgcttcagttcttcccatgattttaaaatcagctcttgaacttgatctcttagaaatcattgctaaagctggacctggtgctcaaatttcacctattgaaattgcttctcagctcccaacctgatgcaccagttatgttggaccgaatgttgcgtctcttggcttgttacaatatcctcacttgttcagttcgtactcaacaagatggaaaggttcagagactttatggtttggctactgttgctaa

SEQ ID NO: 32519 - DNA, 342 bp, Artificial
  MsCOMT deletion introduced by TALEN pair MsCOMT_T03.1
aaacacaaaacctatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgaaattaccctgatgcaccagttatgttggaccgaatgttgcgtctcttggcttgttacaatatcctcacttgttcagttcgtactcaacaagatggaaagattcagagactttatggtttggctactgttgctaa

SEQ ID NO: 32520 - DNA, 264 bp, Artificial
  MsCOMT deletion introduced by TALEN pair MsCOMT_T03.1
aaaaacctcatcaatcacaaccatgggttcaacaggtgaaactcaaataacaccaacccacatatcagatgaagaagcaaacctcttcgccatgcaactagcaagtgcttcagttcttcccatgattttgaagtcagctcttgaacttgatctcttagaaatcattgctaaagctggacctggtgctcaaatttcacctattgaaattgcttctcaacaagatggaaaagttcagagactttatggtttggctactgttgctaa

SEQ ID NO: 32521 - DNA, 295 bp, Artificial
  MsCOMT deletion introduced by TALEN pair MsCOMT_T03.1
aaaaacaaaaacctcatcaatcacaaccatgggttcaacaggtgaaactcaaataacaccaacccacatatcagatgaagaagcaaacctcttcgccatgcaactagcaagtgcttcagttcttcccatgattttgaaatcagctcttgaacttgatctcttagaaatcattgctaaagctggacctggtgctcaaatttcacctattgacttgttacaatatcctcacttgttcagttcgtactcaacaagatggaaaggttcagagactttatggtttggctactgttgctaa

SEQ ID NO: 32522 - protein, 5 aa, Artificial
  Conserved sequence within EPSPS proteins
TAMPR

SEQ ID NO: 32523 - protein, 9 aa, Artificial
  Consensus sequence for dodecapeptide family of homing endonucleases
LAGLIDADG

SEQ ID NO: 32524 - DNA, 6927 bp, Medicago truncatula
  COMT genomic sequence
atgggttcaacaggtgaaactcaaataacaccaactcacatatcagatgaagaagcaaacctcttcgccatgcaactagcaagtgcctcagttcttcccatggttttaaaatcagctcttgaacttgatctcttagaaatcattgctaaagctggacctggtgctcaaatttcacctattgaaattgcttctcagctcccaacaactaaccctgaagcaccggttatgctggaccgtatcttgcgtctattggcttgttacaatatcctcacttgttctgttcgtactcaacaagatggaaaggttcagagactttatggtttggctactgttgctaagtatttggttaagaatgaagatggtgtatccatttctgctcttaacctcatgaatcaggataaagttctcatggaaagctggtatttcactatttcctattctctgttttttactctgtttttattttgctctgttctctgttttattggtactaagaatagatgtgatatattctgaaaatgtgtttacaactgacagatagttctgacttactaattctaggacgaggagtgttaaaatttacctttagatttttgatatggggtaaatataaatgaacaaaatgggtgaatggatcacttagtggaacaatgtttctttactaataattaaaaactagcaggatatggaattatgattgaatcaaattccatatacaacatatttaacacataaataagtgaccaaatatgattggttaggttgttaagattgtgattcatactccactcagattgataaataatctatcagtatttttaacaaatgtgctttaactttaagacatattctagctttaagacacaccttaaacataaaataaaatcataaaacacatcaacaacaaaatgtgagaattagcacccaaaaaaaaaaaaaaagaattggaatttgtattcattattctagttagcttttttgtccttctctctttcccgacgggttattcagtaagctatagacactagacataaatgcagaaatttaaaattcatatgtctttgtaaaatagtacaaagtaacaagaaaccccgtaaaaaaaaaaaacaaattataggtgggaaaacacgtatttgtaaaatagttacctttttcttagggaacttctacggtacattcacaaaataaggtgtaccggtactcttgtttcataattttataaattaacgataattttttatgtaataaataactatttgttaatatttatattttatataacatcattttagaaaaaacatcatttcattgtttataagaattatagtaattatttttacatattattgtaaaaaataatcaatgttctcaattacgagtgataaaaattcaaaaaaattaattttatttcgttgacacttttgatgaataagatttagttgttataattataaatgataaaaaaataatatttttcttaaaaaaacaactcttttaactattaatttaaagagtggatgtatcggtacactcaaatatattgggtgtaccatataatttatcctgctcatattactcagatcatacgcatatttgcttagagaaataatcatgggtcggtgaccgattaaattgacaactacgtagatatctcatagtatatgagaatatttgtttttgatgcattataatttgtttcttacaatgtagtttacgcctttctcatacattttgttctcatggagaggctggaaatctaaaattttgtatagaatatacattattttaaaatgtaacgtttgagactcgatgaacatttagaaaacacaattaatggattacaaaaatgaaatgttttcatttgcacgggaagttaacgtgtaagttaattattcataagtttttaattactccataatggttcttttgaagaaaattaagaatgtttatttagttaaaattttatggttggtttttttttagaggattttatggtaagggattattgcaataaactcgtgtcaattattaagaggaaattgattaatacatggacgatgattatccagaaacactaacctcaaagagttgaaacactaccatcaaagagttgtgttatttgaacatccatatatatatgataacttttgtgacaaccaaaattaaaaaaaaaaaaaggtagtgatacaaaaactaaaacaataaaaaaaaaataaaaaaataatgtaagtatgaaatagaaagttgtcacaaaaattataaaaaataattgttcaaatatcatttctcaacttcgaaagtttcaaattatgacatgatgatgacctagagggaccccccatttttgagtggccaccaactcactattcaacatttctgcatttcacctaccaccaatggagtgtgaaccaatcttcctgcaaagctttcaatagcaatatgaacagttagacaatttcgtaatagtccaagttgtttgtcaaagctcaagactattatggttttacgtacatgtcaacattaaaagaaatcgagtagttgaacgaacttttgcatatagcattaagggttaaaaagtttttatccccttttattcggggtcttttggtttatcctcctatggaataaaacttggagatttcctcctataaaataaagatttttttgtttactctcctccccccacagccaacagtcagcatctgattgaataaatttgatgacatggcgtgctgacacgatattttttattttttttgaatttccatgtggcataatttaaaaaaaaaaaaaaaacttttttataaacacaaaaaacctttttattttgaaaaaaatctgaacttttttaaaaaccccaaattatttaaaaacattcagatttttttaatttttttttttaatttttgtttttattaattttgataattaaatttcataactattaaatatcttcttaattaaaaaaaaaatctgaaatttttttctaattttttaaatttcgaaataaaaacccccagattttttaaaaacattgagatttttttaattttgataattaaatttcaaaacttttaaatatcttcttaatttaaaaaaaaaatctgaattattttttctaattttttaaatttcaaaataaaaacccccagattttttaaaaacattgagatttttttaatttctatttttttattttgataattaaatttcaaaacttttaaatatcttcttaatttaaaacaaaatctgaattttttttttctaattttttaaatttcgaaaaaaacccccagatttttttaatttcaatttttttatttttataattaaatttcagaacttttaaatatctttttaattaaaaaaaatcagattttaaaatttttgaaaaaaaactcccttatatttaaaagtagagaaaaactcgaaattaaaattcagattttttttcaaaataaaaagattttttgttttttttttataaattatgccgcgtggaaattaaaaaaaataaaataaaatattatgttagtagcaaatttatccattcagatgctgactattggttgtggagggggtaaaccaaataatatttattttacagggaaaatctccaaaaaaaaaaattcataggagggtatacctaaaaagcctagtaaccctagtattaattttgggtctcagataaaccaaaaaaatggatagatctttgaacttaagaaaacttggtttggatgttacatatcaaccacaaaagttaaaaaaatatgtatagaatttgtttaatcacatttgacgttataacaaaaaatatcacatttgatgcatcaacattcaaacgatagtgttatgttgatcgaggagggttgagcctaacaaaaaatgataggctttcacagtgttatgaataaaattatttgaagaaaaaagaatctataaaaaagaaaagtctcttattgtaattatataattcaacttaatcaatatggtttagtgaatagaatacattttttaatatggaaaaatggtcccttaaaagtgagtgattatttcaagccaattcactttttgacataaaaagcttatacaattattttctattaaaagtaacaaaatatcatcatgtcaaaattcattatattatcatgtcaaattatttttcctcaaaaaaaaaaaaaaatcactatgtctgttaagttaatttactttgagaaatgatatttgcacgaccactttctcataactttttgacaactttatacattatcctcttattcttcctcttcctttttctctctccattggttttgaccaatgaaaagagagaaaaaataagttttcacaaaagttgtcttatatggttgttcaaataacactactcatttactttatagtgtgcgtttggtttggcggtgacgagaattgatttttatagaattgagtttgagagaattgattttgattaaaagtgagttagatgtgaattgatttttgtttgaatacactttgttaaaagcgattcttatgaattgttgttgtttggatacattgaatcaaaattgcttttagatgtataattaccaaaatagatttttcaatttttttaattttttttttgtttcaaataattatttagtatacgtcgataataataattttatttaggggatccatgataataacttctttttttaaggaccataataataacttttttttgttttgttgaagaaccataataaatattaataataacttaaaaactattttttttcctaaaaaaaaatgtaaaaactaataaaaacatatagtagtaattaattaatgattataataaataacaaagggaaggaacaaaacgcatagcaaaacaaacagaaaagaaaatatacaaattttctggaagctacttgatgtgaagaaaacaaaaaatagagatcctggaagttgcttgatgtgaagaaaacaagaaaaaaaatgctgaatgctgagacagtgaatagaaacttaaatgggttgttcaagagggagagaaggaagaaaacgatatagatctgaaagagaacgagatagatctgagggcaaagaaggaagaaatgagttttttaactgccaaatctacagtaaacaaaaattgattttgggattcaccgcagaaactaggaatatgatgagcttcagcagaactggcgttttgggcctaaaatcatgtttcctggaatcgctttttcttcatccaaacaagataaaaattaggaaaacggtgtttgacaaaagaaacttaggtttggcttgtggaaaagtgatgccaaacacatacatagtggttctatacacatcatttttgttttatcaatatcctatggcatgaatgaactacaactagatatcttaaccatgtgattaggattttaatctccagcggtgtaggaaataattttttttttgaataaagtatgaaataatatatgtttggtgatgtcaacactttaaatgaatctcgacatcttgagtaattagtcatcgacttctaatgagagattgccgaagttaacccaaataatgggttatagtatacaagtaattaaattgtttttctttacgagaaattgtattcatctcatgcttagatgacataaaaaccttaaaataaagatgacataaaaacactttctattctgcaaaaacatcaacatccttccaattgcacacacattctctctattatgagaaatagtaatccttagtccttactcattgtaggtaccacctaaaagatgcagtccttgatgggggcattccattcaacaaggcttatggaatgacagcctttgaataccatggaacagatccaaggtttaacaaggttttcaacaaggggatgtctgatcactctaccatcacaatgaagaaaattcttgagacctacacaggttttgaaggccttaaatctcttgttgatgtaggtggtggtactggagctgtaattaacacgattgtctcaaaatatcccaccattaagggtattaattttgatttaccccatgtcattgaagatgctccatcttatccaggtactttttttcttatgtttaaccgcgctgcttagtttacatgtcattgtcttaaacaattagtattaggttttacagcatatttgaacaaaattacttactacaatatatgtagaattgacattgatgttttgtgtaggagttgagcatgttggtggagacatgtttgtcagtattccaaaggctgatgctgtttttatgaaggtgcattttataaatcttacctaccctaacacaatgttttggccttcttctatacgctaacagtagcaccgacacttgagatagaggaaatgtcaggtgtcattgtcaacatgtttatatccatgctttccataacatagttgttttagcctttacatttgatatacttcaaatcatattcctcttgtttacataaaattcgcgaagagaataactctgtcactaaatttagaaatgcaatgaaagaaaggtttattttatatttttcttaactaaaatttgttactacattaatttttctgatagtatatgctaattatgatatcattttatatgcatatagtggatttgtcatgactggagtgatgagcactgcttgaaatttttgaagaactgctatgaagcactaccagacaatggaaaagtgattgtggcagaatgcatacttccagtggctccagattcaagcctggccacaaaaggtgtggttcacattgatgcaatcatgttggctcataatccaggtgggaaagagagaacacagaaagagtttgaggatcttgccaaaggtgctggattccaaggtttcaaagttcattgtaatgctttcaacacatacatcatggaatttcttaagaaggtttaa

SEQ ID NO: 32525 - protein, 365 aa, Medicago truncatula
  COMT Protein Sequence
MGSTGETQITPTHISDEEANLFAMQLASASVLPMILKSALELDLLEIIAKAGPGAQISPIEIASQLPTTNPDAPVMLDRMLRLLACYNILTCSVRTQQDGKVQRLYGLATVAKYLVKNEDGVSISALNLMNQDKVLMESWYHLKDAVLDGGIPFNKAYGMTAFEYHGTDPRFNKVFNKGMSDHSTITMKKILETYTGFEGLKSLVDVGGGTGAVINTIVSKYPTIKGINFDLPHVIEDAPSYPGVEHVGGDMFVSIPKADAVFMKWICHDWSDEHCLKFLKNCYEALPDNGKVIVAECILPVAPDSSLATKGVVHIDVIMLAHNPGGKERTQKEFEDLAKGAGFQGFKVHCNAFNTYIMEFLKKV

SEQ ID NO: 32526 - DNA, 44 bp, Artificial Sequence
  MsCOMT deletion introduced by TALEN pair MsCOMT_T01.1
ttcaacaggtgaaactcaaaccaacccacatatcagatgaagaa

SEQ ID NO: 32527 - DNA, 39 bp, Artificial Sequence
  MsCOMT deletion introduced by TALEN pair MsCOMT_T01.1
ttcaacaggtgaaactcaacccacatatcagatgaagaa

SEQ ID NO: 32528 - DNA, 36 bp, Artificial Sequence
  MsCOMT deletion introduced by TALEN pair MsCOMT_T01.1
ttcaacaggtgaaactcccacatatcagatgaagaa

SEQ ID NO: 32529 - DNA, 38 bp, Artificial Sequence
  MsCOMT deletion introduced by TALEN pair MsCOMT_T02.1
tgaacttgatctcttagaaagctggacctggtgctcaa

SEQ ID NO: 32530 - DNA, 33 bp, Artificial Sequence
  MsCOMT deletion introduced by TALEN pair MsCOMT_T02.1
tgaacttgatctaaagctggacctggtgctcaa

SEQ ID NO: 32531 - DNA, 43 bp, Artificial Sequence
  MsCOMT deletion introduced by TALEN pair MsCOMT_T02.1
tgaacttgatctcttagaaactaaagctggacctggtgctcaa

SEQ ID NO: 32532 - DNA, 39 bp, Artificial Sequence
  MsCOMT deletion introduced by TALEN pair MsCOMT_T02.1
tgaacttgatctcttactaaagctggacctggtgctcaa

SEQ ID NO: 32533 - DNA, 65 bp, Artificial Sequence
  MsCOMT deletion introduced by TALEN pair MsCOMT_T03.1
tcacctattgaaattgcttctcagctacctgatgcaccagttatgttggaccgaatgttgcgtct

SEQ ID NO: 32534 - DNA, 47 bp, Artificial Sequence
  MsCOMT deletion introduced by TALEN pair MsCOMT_T03.1
tcacctattgaagatgcaccagttatgttggaccgaatgttgcgtct

SEQ ID NO: 32535 - DNA, 57 bp, Artificial Sequence
  MsCOMT deletion introduced by TALEN pair MsCOMT_T03.1
tcacctattgaaattgcttctcagctcaccagttatgttggaccgaatgttgcgtct

SEQ ID NO: 32536 - DNA, 20 bp, Artificial Sequence
  MsCOMT deletion introduced by TALEN pair MsCOMT_T03.1
tcacctattgtgttgcgtct

SEQ ID NO: 32537 - DNA, 39 bp, Artificial Sequence
  MsCOMT deletion introduced by TALEN pair MsCOMT_T02.1
tgaacttgatctcttagaaaagctggacctggtgctcaa

SEQ ID NO: 32538 - protein, 12 aa, Artificial Sequence
  mutant sequence
IASQLPDAPVML

SEQ ID NO: 32539 - protein, 14 aa, Artificial Sequence
  mutant sequence
ELDLLETKAGPGAQ

SEQ ID NO: 32540 - DNA, 24 bp, Artificial Sequence
  synthetic primer
tctcacaaaaacctcatcaatcac

SEQ ID NO: 32541 - DNA, 20 bp, Artificial Sequence
  synthetic primer
ttagcaacagtagccaaacc
